US008946511B2

(12) United States Patent
Allen et al.

(10) Patent No.: US 8,946,511 B2
(45) Date of Patent: Feb. 3, 2015

(54) PLANT MICRORNAS AND METHODS OF USE THEREOF

(75) Inventors: Edwards Allen, O'Fallon, MO (US); Barry S. Goldman, St. Louis, MO (US); Liang Guo, St. Louis, MO (US); Sara E. Heisel, St. Louis, MO (US); Shihshieh Huang, Stonington, CT (US); Sergey I. Ivashuta, Ballwin, MO (US); David K. Kovalik, Clayton, MO (US); Elysia K. Krieger, Kirkwood, MO (US); James K. Roberts, Chesterfield, MO (US); Yuanji Zhang, Weldon Spring, MO (US)

(73) Assignee: Monsanto Technology LLC, St. Louis, MO (US)

(*) Notice: Subject to any disclaimer, the term of this patent is extended or adjusted under 35 U.S.C. 154(b) by 1394 days.

(21) Appl. No.: 11/974,469

(22) Filed: Oct. 12, 2007

(65) Prior Publication Data

US 2009/0070898 A1 Mar. 12, 2009

Related U.S. Application Data

(60) Provisional application No. 60/851,187, filed on Oct. 12, 2006, provisional application No. 60/908,826, filed on Mar. 29, 2007, provisional application No. 60/969,195, filed on Aug. 31, 2007.

(51) Int. Cl.
C12N 15/82 (2006.01)
C12N 15/00 (2006.01)
A01H 5/00 (2006.01)

(52) U.S. Cl.
CPC ........ *C12N 15/8218* (2013.01); *C12N 15/8216* (2013.01); *C12N 15/8238* (2013.01); *C12N 15/8261* (2013.01); *C12N 15/8271* (2013.01); *C12N 15/8273* (2013.01); *C12N 15/8279* (2013.01); *C12N 15/8286* (2013.01)
USPC ........... 800/285; 800/278; 800/295; 800/286; 536/24.5

(58) Field of Classification Search
USPC ....................................................... 800/285
See application file for complete search history.

(56) References Cited

U.S. PATENT DOCUMENTS

| | | | |
|---|---|---|---|
| 5,004,863 A | 4/1991 | Umbeck |
| 5,015,580 A | 5/1991 | Christou et al. |
| 5,159,135 A | 10/1992 | Umbeck |
| 5,416,011 A | 5/1995 | Hinchee et al. |
| 5,463,174 A | 10/1995 | Moloney et al. |
| 5,500,365 A | 3/1996 | Fischhoff et al. |
| 5,518,908 A | 5/1996 | Corbin et al. |
| 5,538,880 A | 7/1996 | Lundquist et al. |
| 5,550,318 A | 8/1996 | Adams et al. |
| 5,569,834 A | 10/1996 | Hinchee et al. |
| 5,591,616 A | 1/1997 | Hiei et al. |
| 5,633,435 A | 5/1997 | Barry et al. |
| 5,750,848 A | 5/1998 | Krüger et al. |
| 5,763,245 A | 6/1998 | Greenplate et al. |
| 5,780,708 A | 7/1998 | Lundquist et al. |
| 5,824,877 A | 10/1998 | Hinchee et al. |
| 5,837,848 A | 11/1998 | Ely et al. |
| 5,888,732 A | 3/1999 | Hartley et al. |
| 5,981,840 A | 11/1999 | Zhao et al. |
| 6,084,089 A | 7/2000 | Mine et al. |
| 6,118,047 A | 9/2000 | Anderson et al. |
| 6,140,078 A | 10/2000 | Sanders et al. |
| 6,153,812 A | 11/2000 | Fry et al. |
| 6,160,208 A | 12/2000 | Lundquist et al. |
| 6,194,636 B1 | 2/2001 | McElroy et al. |
| 6,207,879 B1 | 3/2001 | McElroy et al. |
| 6,232,526 B1 | 5/2001 | McElroy et al. |
| 6,252,138 B1 | 6/2001 | Karimi et al. |
| 6,277,608 B1 | 8/2001 | Hartley et al. |
| 6,288,312 B1 | 9/2001 | Christou et al. |
| 6,294,714 B1 | 9/2001 | Matsunaga et al. |
| 6,372,965 B1 | 4/2002 | Lightner et al. |
| 6,384,301 B1 | 5/2002 | Martinell et al. |
| 6,399,861 B1 | 6/2002 | Anderson et al. |
| 6,403,865 B1 | 6/2002 | Koziel et al. |
| 6,426,446 B1 | 7/2002 | McElroy et al. |
| 6,426,448 B1 | 7/2002 | Booth, Jr. et al. |

(Continued)

FOREIGN PATENT DOCUMENTS

| WO | WO 91/11524 A1 | 8/1991 |
|---|---|---|
| WO | WO 95/06128 A2 | 3/1995 |

(Continued)

OTHER PUBLICATIONS

Liu et al. 2006, Genbank Accession No. CT833344.*
Liu et al. 2007, Plant Mol. Biol. 65:403-415.*
Ebert, et al; MicroRNA Sponges: Competitive Inhibitors of Small RNAs in Mammalian Cells; Sep. 2007; 721-26; vol. 4, No. 9; Nature Methods.
Franco-Zorilla, et al; Target Mimicry Provides a New Mechanism for Regulation of MicroRNA Activity; Aug. 2007; 1033-37; vol. 39, No. 8; Nature Genetics.
PCT/US2007/021987 Preliminary Report on Patentability dated Apr. 23, 2009.
AU2007352460. First Examination Report issued Jul. 16, 2012.
CN2007800457886. First Office Action issued Apr. 18, 2012.

(Continued)

Primary Examiner — Li Zheng
(74) Attorney, Agent, or Firm — Amanda Carmany-Rampey; Maria Margarita D. Unson; Arnold & Porter LLP

(57) ABSTRACT

This invention discloses novel microRNAs and their precursors, and recombinant DNA constructs including such novel miRNAs, miRNA precursors, miRNA promoters, and miRNA recognition sites corresponding to the miRNAs. Included are novel miRNA and miRNA precursors that exhibit nutrient-responsive expression. Also disclosed are miRNA decoy sequences. Further provided are non-natural transgenic plant cells, plants, and seeds containing in their genome a recombinant DNA construct of this invention and methods of controlling gene expression using recombinant DNA constructs of this invention.

6 Claims, 24 Drawing Sheets

(56) References Cited

U.S. PATENT DOCUMENTS

| | | | |
|---|---|---|---|
| 6,429,357 | B1 | 8/2002 | McElroy et al. |
| 6,433,252 | B1 | 8/2002 | Kriz et al. |
| 6,437,217 | B1 | 8/2002 | McElroy et al. |
| 6,583,338 | B2 | 6/2003 | McElroy et al. |
| 6,759,575 | B2 | 7/2004 | Michiels et al. |
| 6,872,872 | B1 | 3/2005 | Lightner et al. |
| 6,953,835 | B2 | 10/2005 | Fischhoff et al. |
| 2002/0133852 | A1 | 9/2002 | Hauge et al. |
| 2003/0005491 | A1 | 1/2003 | Hauge et al. |
| 2003/0049612 | A1 | 3/2003 | Echt et al. |
| 2003/0167537 | A1 | 9/2003 | Jiang |
| 2004/0098761 | A1 | 5/2004 | Trick et al. |
| 2004/0115642 | A1 | 6/2004 | Fu |
| 2004/0123347 | A1 | 6/2004 | Hinchey et al. |
| 2004/0216189 | A1 | 10/2004 | Houmard et al. |
| 2004/0244075 | A1 | 12/2004 | Cai et al. |
| 2005/0120415 | A1 | 6/2005 | Aukerman |
| 2005/0144669 | A1 | 6/2005 | Reinhart et al. |
| 2006/0021087 | A1 | 1/2006 | Baum et al. |
| 2006/0200878 | A1 | 9/2006 | Lutfiyya et al. |
| 2006/0236427 | A1* | 10/2006 | Chiang et al. .............. 800/284 |
| 2007/0271630 | A1 | 11/2007 | Boukharov et al. |
| 2009/0068159 | A1 | 3/2009 | Baum et al. |

FOREIGN PATENT DOCUMENTS

| | | |
|---|---|---|
| WO | WO 02/057471 A2 | 7/2002 |
| WO | WO 02/062129 A2 | 8/2002 |
| WO | WO 2004/071426 A2 | 8/2004 |
| WO | WO 2005/007829 A2 | 1/2005 |
| WO | WO 2005/110068 A2 | 11/2005 |
| WO | WO 2006/073727 A1 | 7/2006 |
| WO | WO 2006/105436 A2 | 10/2006 |
| WO | WO 2006/2015436 A1 | 10/2006 |
| WO | WO 2008/045460 A1 | 4/2008 |

OTHER PUBLICATIONS

CN2007800457886. Second Office Action issued Jan. 11, 2013.
CN2007800457886. Rejection Decision issued Jul. 3, 2013.
AU2007352460. Notice of Acceptance issued Sep. 6, 2012.
EP078740826. Office Action issued Feb. 7, 2012.
EP078740826. Supplemental Search Report issued Feb. 4, 2010.
EP078740826. Office Action issued Nov. 16, 2010.
EP078740826. Office Action issued Oct. 2, 2013.
EP 121926604 Supplemental Search Report dated Jul. 5, 2013.
Alvarez et al. "Endogenous and Synthetic MicroRNAs Stimulate Simultaneous, Efficient, and Localized Regulation of Multiple Targets in Diverse Species". PlantCell. vol. 18. pp. 1134-1151. Apr. 7, 2006.
Axtell et al. "A two-hit trigger for siRNA biogenesis in plants." Cell. vol. 127. pp. 565-577. Nov. 3, 2006.
Berkhout et al. "The interplay between virus infection and the cellular RNA interference machinery". FEBS. vol. 580. pp. 2896-2902. Feb. 25, 2006.
Dugas et al. "MicroRNA regulation of gene expression in plants." PlantBiology. vol. 7. pp. 512-520. Jul. 11, 2004.
Franco et al. "Target mimicry provides a new mechanism for regulation of microRNA activity." NatureGenetics. vol. 39. pp. 1033-1037. Jul. 22, 2007.
Gitlin et al. "Poliovirus escape from RNA interference: short interfering RNA-target recognition and implications for therapeutic approaches." Virology. vol. 79. pp. 1027-1035. Aug. 19, 2004.
Mallory et al. "Functions of microRNAs and related small RNAs in plants." NatureGenetics. vol. 38. pp. 31-36. May 30, 2006.
Mallory et al. "MicroRNA control of PHABULOSA in leaf development: importance of pairing to the microRNA 5' region." EMBO. vol. 23. pp. 3356-3364. Jul. 29, 2004.
Palatnik et al. "Control of leaf morphogenesis by microRNAs." Nature. vol. 425. pp. 257-263. Sep. 18, 2003.
Schwab et al. "Specific effects of microRNAs on the plant transcriptome." DevCell. vol. B. pp. 517-527. Apr. 2005.
IN 2497CHENP2009 Exam Report dated Feb. 20, 2014.
Fujii et al. "MiRNA involved in phosphate starvation response in Arabidopsis." Current Bio. vol. 17. No. 22. pp. 2038-2043. Nov. 22, 2005.
Jones-Rhoades et al. "MicroRNAs and their regulatory roles in plants." Annual Review. vol. 57. pp. 19-53. Jan. 30, 2006.
Allen et al., "Evolution of microRNA genes by inverted duplication of target gene sequences in *Arabidopsis thaliana*," *Nature Genetics*, 36(12):1282-1290 (2004).
Allen et al., "microRNA-Directed Phasing during *Trans*-Acting siRNA Biogenesis in Plants," *Cell*, 121:207-221 (2005).
Altschul et al., "Basic Local Alignment Search Tool," *J. Mol. Biol.*, 215:403-410 (1990).
Altschul et al., "Gapped BLAST and PSI-BLAST: a new generation of protein database search programs," *Nucleic Acids Research*, 25(17):3389-3402 (1997).
Ambros et al., "A uniform system for microRNA annotation," *RNA*, 9:277-279 (2003).
Aslanidis et al., "Ligation-independent cloning of PCR products (LIC-POR)," *Nucleic Acids Research*, 18(20):6069-6074 (1990).
Aukerman et al., "Regulation of Flowering Time and Floral Organ Identity by a MicroRNA and Its *APETALA2*-Like Target Genes," *Plant Cell*, 15:2730-2741 (2003).
Aung et al., "*pho2*, a Phosphate Overaccumulator, is Caused by a Nonsense Mutation in a MicroRNA399 Target Gene," *Plant Physiology*, 3(141):1000-1011 (2006).
Bari et al., "PHO2, MicroRNA399, and PHR1 Define a Phosphate-Signaling Pathway in Plants," *Plant Physiology*, 141:988-999 (2006).
Bartel, "MicroRNAs: Genomics, Biogenesis, Mechanism, and Function" *Cell*, 116:281-297 (2004).
Bayer et al., "Programmable ligand-controlled riboregulators of eukaryotic gene expression," *Nature Biotechnol.*, 23:337-343 (2005).
Becker et al., "Fertile transgenic wheat from microprojectile bombardment of scutellar tissue," *The Plant Journal*, 5:299-307 (1994).
Boutros et al., "Genome-Wide RNAi Analysis of Growth and Viability in Drosophila Cells," *Science*, 303:832-835 (2004).
Brodersen et al., "The diversity of RNA silencing pathways in plants," *Trends Genetics*, 22:268-280 (2006).
Bytebier et al., "T-DNA organization in tumor cultures and transgenic plants of the monocotyledon *Asparagus officinalis*," *Proc. Natl. Acad. Sci. U.S.A.*, 84:5345-5349 (1987).
Cai et al., "Kaposi's sarcoma-associated herpesvirus expresses an array of viral microRNAs in latently infected cells," *PNAS*, 102:5570-5575 (2005).
Cheng et al., "Production of fertile transgenic peanut (*Arachis hypogaea* L.) plants using *Agrobacterium tumefaciens*," *Plant Cell Reports*, 15:653-657 (1996).
Chiou et al., "Regulation of Phosphate Homeostasis by MicroRNA in *Arabidopsis*," *The Plant Cell*, 18:412-421 (2006).
Davidson et al., "Engineering regulatory RNAs," *TRENDS in Biotechnology*, 23(3):109-112 (2005).
De Amicis et al., "Intercodon dinucleotides affect docon choice in plant genes," *Nucleic Acid Research*, 28(17):3339-3346 (2000).
De Framond, "MINI-Ti: A New Vector Strategy for Plant Genetic Engineering," *Nature Biotechnology*, 1:262-269 (1983).
Di Giusto et al., "Construction, Stability, and Activity of Multivalent Circular Anticoagulant Aptamers," *The Journal of Biological Chemistry*, 279(45):46483-46489 (2004).
Donnelly et al., "Analysis of the aphthovirus 2A/2B polyprotein 'cleavage' mechanism indicates not a proteolytic reaction, but a novel translational effect: a putative ribosomal 'skip',", *Journal of General Virology*, 82:1013-1025 (2001).
Donnelly et al., "The 'cleavage' activities of foot-and-mouth disease virus 2A site-directed mutants and naturally occurring '2A-like'sequences," *Journal of General Virology*, 82:1027-1041 (2001).
Du et al., "A systematic analysis of the silencing effects of an active siRNA at all single-nucleotide mismatched target sites," *Nucleic Acids Research*, 33(5):1671-1677 (2005).
Erdmann et al., "The non-coding RNAs as riboregulators," *Nucleic Acids Res.*, 29:189-193 (2001).

(56) References Cited

OTHER PUBLICATIONS

Fu et al., "Quality assessment of maize assembled genomic islands (MAGIs) and large-scale experimental verification of predicted genes," *PNAS*, 102(34):12282-12287 (2005).
Gottesman, Micros for microbes: non-coding regulatory RNAs in bacteria, *Trends Genet.*, 21:399-404 (2005).
Green, "Control of mRNA Stability in Higher Plants,"*Plant Physiol.*, 102:1065-1070 (1993).
Griffiths-Jones et al., "Rfam: an RNA family database," *Nucleic Acids Research*, 31(1):439-441 (2003).
Griffiths-Jones et al., "Rfam: annotating non-coding RNAs in complete genomes," *Nucleic Acids Res.*, 33:121-124 (2005).
Hoekema et al., "A binary plant vector strategy based on separation of vir- and T-region of the *Agrobacterium tumefaciens* Ti-plasmid," *Nature*, 303:179-180 (1983).
Hofacker et al., "Fast Folding and Comparison of RNA Secondary Structures," *Monatsh. f. Chemie*, 125:167-188 (1994).
Isaacs et al., "Engineered riboregulators enable post-transcriptional control of gene expression," *Nature Biotechnology*, 22(7):841-847 (2004).
Jones-Rhoades et al., "Computational Identification of Plant MicroRNAs and Their Targets, Including a Stress-Induced miRNA," *Molecular Cell*, 14:787-799 (2004).
Kasschau et al., "P1/HC-Pro, a Viral Suppressor of RNA Silencing, Interferes with *Arabidopsis* Development and miRNA Function," *Developmental Cell*, 4:205-217 (2003).
Khvorova et al., "Functional siRNAs and miRNAs Exhibit Strand Bias," *Cell*, 115:209-216 (2003).
Kidner et al., "Spatially restricted microRNA directs leaf polarity through ARGONAUTE1," *Nature*, 428:81-84 (2004).
Kim, "MicroRNA Biogenesis: Coordinated Cropping and Dicing," *Nature Reviews |Molecular Cell Biology*, 6:376-385 (2005).
Lee et al., "MicroRNA maturation: stepwise processing and subcellular localization," *The EMBO Journal*, 21(17):4663-4670 (2002).
Llave et al., "Cleavage of Scarecrow-like mRNA Targets Directed by a Class of *Arabidopsis* miRNA," *Science*, 297:2053-2056 (2002).
Lund et al., "Nuclear Export of MicroRNA Precursors," *Science*, 303:95-98 (2004).
Mallory et al., "MicroRNA Regulation of NAC-Domain Targets is Required for Proper Formation and Separation of Adjacent Embryonic, Vegetative, and Floral Organs," *Current Biology*, 14:1035-1046 (2004).
Mandal et al., "Gene Regulation by Riboswitches," *Nature Reviews |Molecular Cell Biology*, 5:451-463 (2004).
Margulies et al., "Genome sequencing in microfabricated high-density picolitre reactors," *Nature*, 437:376-380 (2005).
Masoud et al., "Constitutive expression of an inducible β-1,3-glucanase in alfalfa reduces disease severity caused by the oomycete pathogen *Phytophthora megasperma* f. sp *medicaginis*, but does not reduce diesease severity of chitin-containing fungi," *Transgenic Research*, 5:313-323 (1996).
MeGraw et al., "MicroRNA promoter element discovery in *Arabidopsis*," *RNA Society*, 12:1612-1619 (2006).
Millar et al., "Plant and animal microRNAs: similarities and differences," *Funct. Integr. Genomics*, 5:129-135 (2005).
Morris et al., "Slowing Down the Ras Lane: miRNAs as Tumor Suppressors?," *Science's STKE*, pe41:1-4 (2005).
Murchison et al., "miRNAs on the move: miRNA biogenesis and the RNAi machinery," *Current Opinion in Cell Biology*, 16:223-229 (2004).
Newman et al., "DST Sequences, Highly Conserved among Plant *SAUR* Genes, Target Reporter Transcripts for Rapid Decay in Tobacco," *The Plant Cell*, 5:701-714 (1993).
O'Donnell et al., "c-Myc-regulated microRNAs modulate E2F1 expression,"*Nature*, 435:839-843 (2005).
Ohme-Takagi et al., "The effect of sequences with high AU content on mRNA stability in tobacco," *Proc. Natl. Acad. Sci. USA*, 90:11811-11815 (1993).
Parizotto et al., "In vivo investigation of the transcription, processing, endonucleolytic activity, and functional relevance of the spatial distribution of a plant miRNA," *Genes Dev.*, 18:2237-2242 (2004).
Peng et al., "A mutation in *NLA*, which encodes a RING-type ubiquitin ligase, disrupts the adaptability of *Arabidopsis* to nitrogen limitation," *Plant J.*, 50:320-337 (2007).
Reinhart et al., "MicroRNAs in plants," *Genes Dev.*, 16:1616-1626 (2002).
Reynolds et al., "Rational siRNA design for RNA interference," *Nature Biotechnol.*, 22:326-330 (2004).
Rhoades et al., "Prediction of Plant MicroRNA Targets," *Cell*, 110:513-520 (2002).
Staple et al., "Pseudoknots: RNA Structures with Diverse Functions," *PLoS Biology*, 3(6):0956-0959 (2005).
Sudarsan et al., "Metabolite-binding RNA domains are present in the genes of eukaryotes," *RNA*, 9:644-647 (2003).
Sun et al., "A Highly Efficient Transformation Protocol for Micro-Tom, a Model Cultivar for Tomato Functional Genomics," *Plant Cell Physiol.*, 47:426-431 (2006).
Sunkar et al., "Novel and Stress-Regulated MicroRNAs and Other Small RNAs from *Arabidopsis*," *The Plant Cell*, 16:2001-2019 (2004).
Tang, "siRNA and miRNA: an insight into RISCs," *Trends in Biochemical Sciences*, 30(2):106-114 (2005).
Ticconi et al., "Short on phosphate: plant surveillance and countermeasures," *Trends in Plant Science*, 9(11):548-555 (2004).
Tomari et al., "MicroRNA Biogenesis: Drosha Can't Cut it without a Partner," *Current Biology*, 15(2):R61-64 (2005).
Tomari et al., "Perspective: machines for RNAi," *Genes & Dev.*, 19:517-529 (2005).
Toriyama et al., "Transgenic Rice Plants After Direct Gene Transfer Into Protoplasts," *Bio/Technology*, 6:1072-1074 (1988).
Vasil et al., "Herbicide Resistant Fertile Transgenic Wheat Plants Obtained by Microprojectile Bombardment of Regenerable Embryogenic Callus," *Bio/Technology*,10:667-674 (1992).
Vettore et al., "The libraries that made SUCEST," *Genetics and Molecular Biology*, 24:1-7 (2001).
Wan et al., "Generation of Large Numbers of Independently Transformed Fertile Barley Plants," *Plant Physiol.*, 104:37-48 (1994).
Wang et al., "Structure and Expression Profile of the *Arabidopsis PHO1* Gene Family Indicates a Broad Role in Inorganic Phosphate Homeostasis," *Plant Physiology*, 135:400-411 (2004).
Winkler et al., "Thiamine derivatives bindmessenger RNAs directly to regulate bacterial gene expression," *Nature*, 419:952-956 (2002).
Xie et al., "Genetic and Functional Diversification of Small RNA Pathways in Plants," *PLoS Biol.*, 2:642-652 (2004).
Xie et al., "Expression of *Arabidopsis* MIRNA Genes," *Plant Physiology*, 138:2145-2154 (2005).
Yamasaki et al., "Regulation of Copper Homeostasis by Micro-RNA in *Arabidopsis*," *The Journal of Biological Chemistry*, 282(22):16369-16378 (2007).
Zhang et al., "Transgenic rice plants produced by electroporation-mediated plasmid uptake into protoplasts," *Plant Cell Reports*, 7:379-384 (1988).
Zhang et al., "DEG: a database of essential genes," *Nucleic Acids Research*, 32:D271-D272 (2004).
Zhang, "miRU: an automated plant miRNA target prediction server," *Nucleic Acids Research*, 33:W701-704 (2005).
EP121926604—Extended Search Report issued Oct. 21, 2013.
PCTUS2007021987—Written Opinion issued Mar. 16, 2009.
PCTUS2007021987—IPRP issued Jan. 18, 2013.
PCTUS2007021987—IPRP issued May 24, 2013.

\* cited by examiner

FIGURE 2
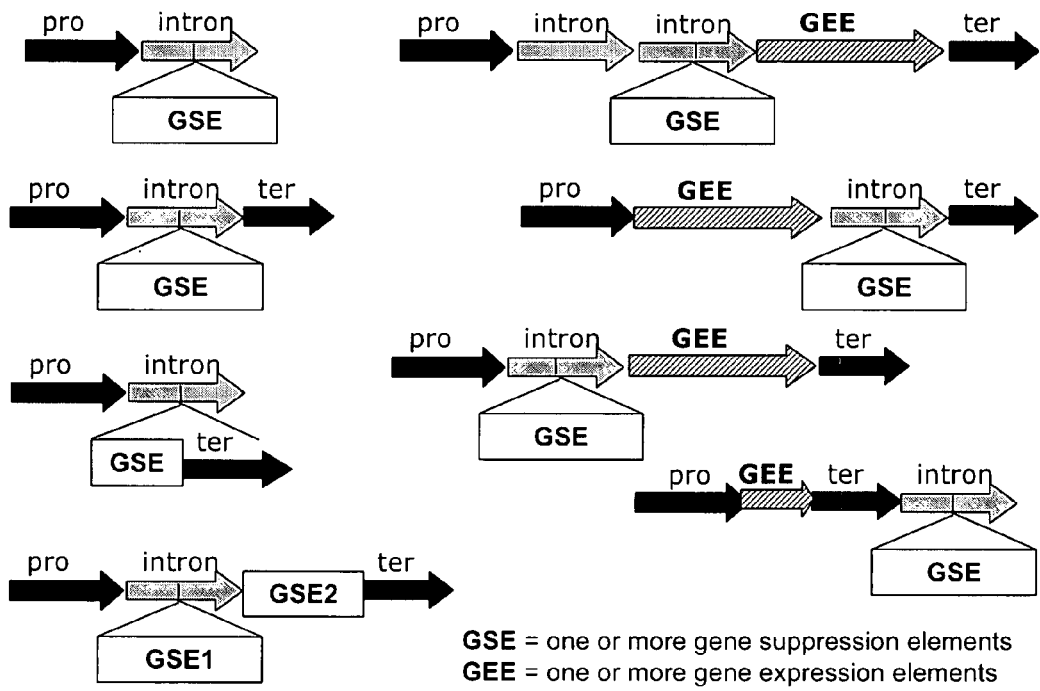
A
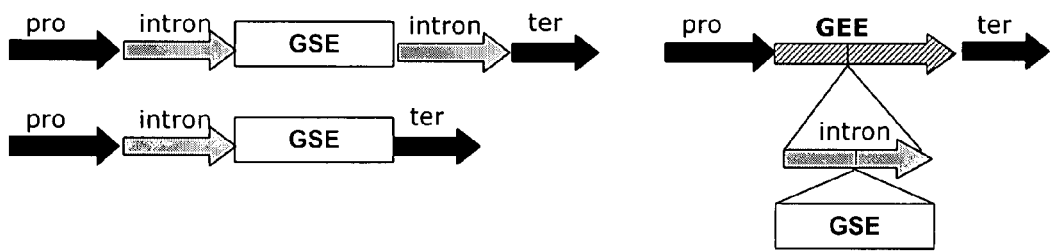
B

FIGURE 7
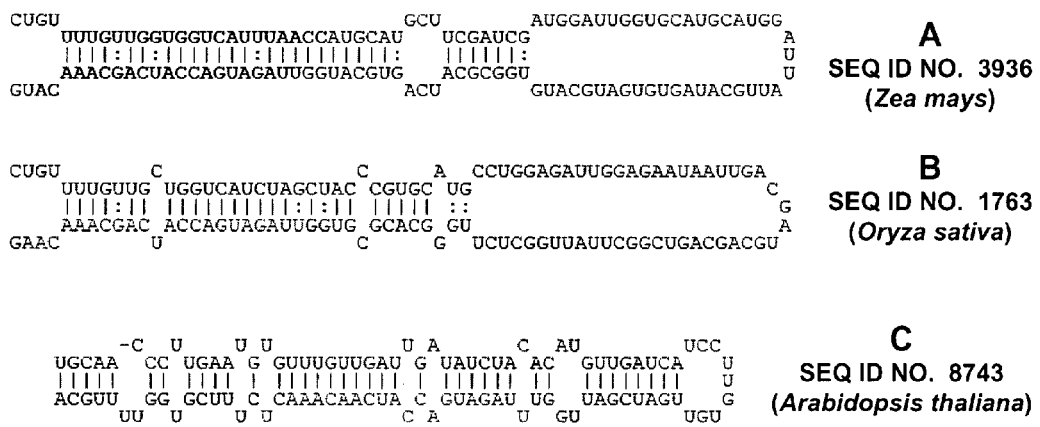
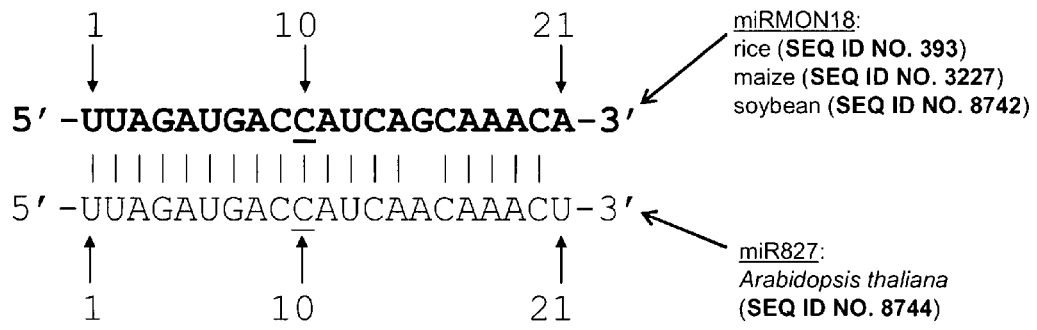
D

FIGURE 8
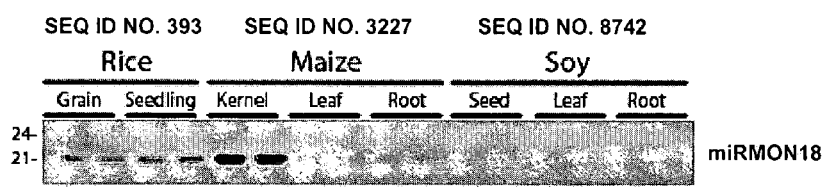
A
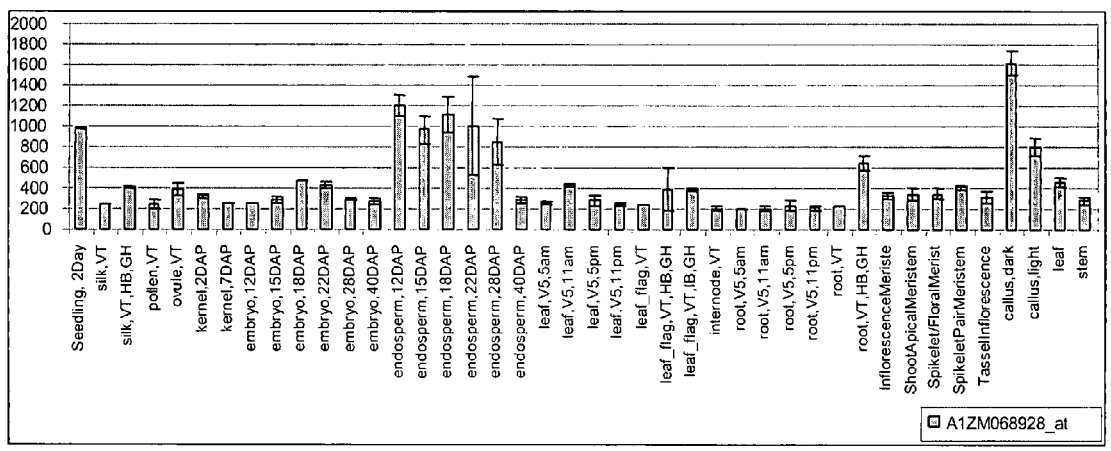
B

FIGURE 9
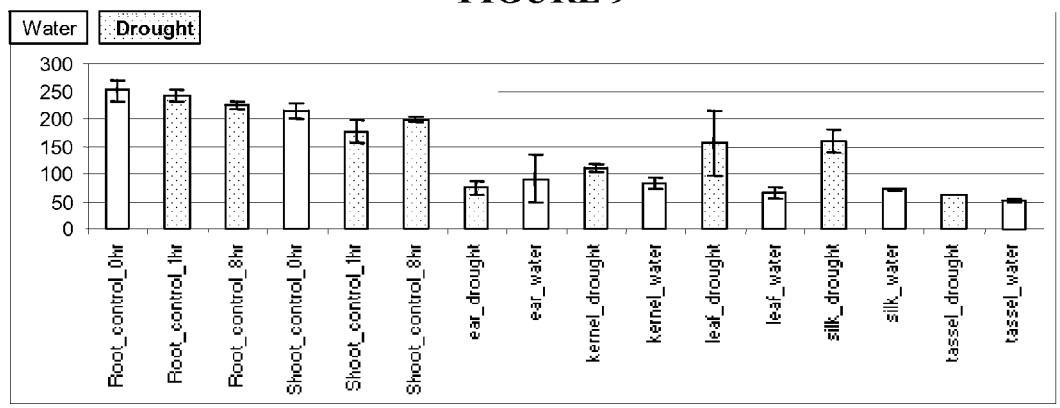
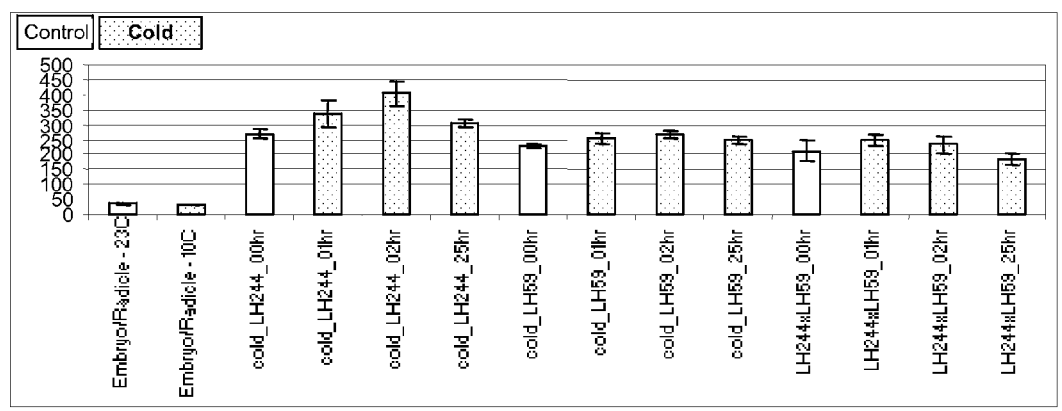
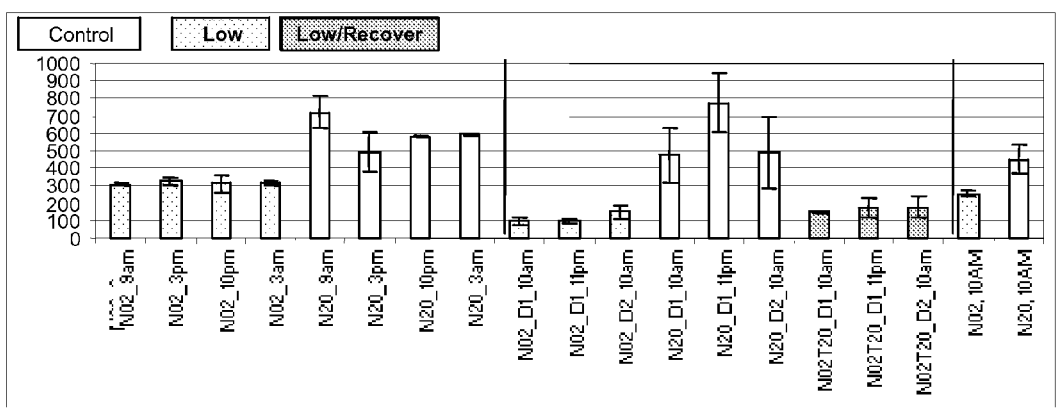

FIGURE 10
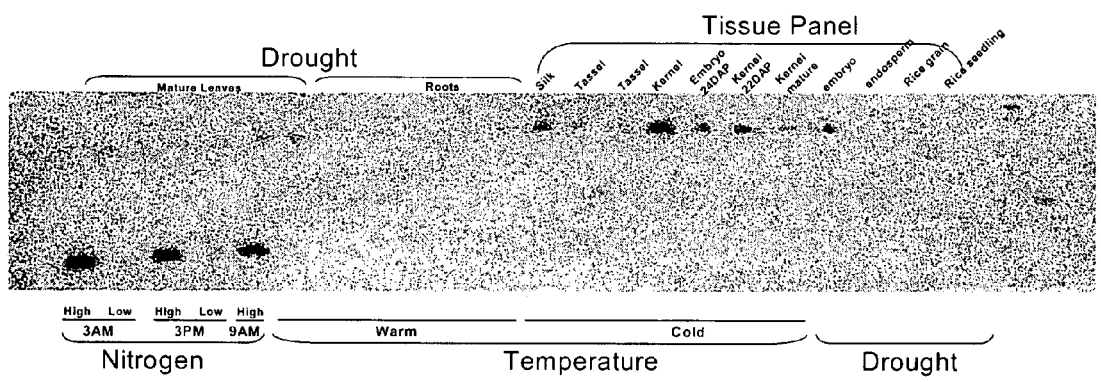
A
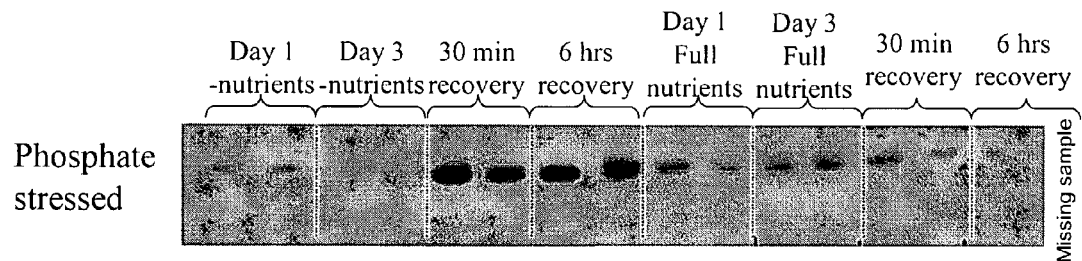
B

FIGURE 11

| | | |
|---|---|---|
| SPX_MFS_126116193_plus_est_sti | (SEQ ID NO. 8766) | MVNFGKKLMADQIPEWKGYYINYKLMKKKVKQYGQQLQQGEKDRRRVLKD |
| fs_SPX_MFS_126116193_plus_est_ | (SEQ ID NO. 8765) | MVNFGKKLMADQIPEWKGYYINYKLMKKKVKQYGQQLQQGEKDRRRVLKD |
| SPX_MFS_118200525_cdna.pep | (SEQ ID NO. 8761) | ------------------------------------------------- |
| SPX_MFS_118200525_2_pep | (SEQ ID NO. 8763) | ------------------------------------------------- |
| SPX_MFS_117961287_cdna.pep | (SEQ ID NO. 8757) | MVNFGKKLMADQVDEWKGYYINYKLMKKMLKQYVQQTQHDEKDREQVLKD |
| SPX_MFS_117961287_2_cdna.pep | (SEQ ID NO. 8759) | ------------------------------------------------- |

| | | |
|---|---|---|
| SPX_MFS_126116193_plus_est_sti | (SEQ ID NO. 8766) | FSKMLDDQIEKIALFLLEQQGMLASRIEELGKQRAILQDQPDISGIAELR |
| fs_SPX_MFS_126116193_plus_est_ | (SEQ ID NO. 8765) | FSKMLDDQIEKIVLFLLEQQGLLASRIEKLGKQRAILQEQPDISGIAELR |
| SPX_MFS_118200525_cdna.pep | (SEQ ID NO. 8761) | ------------------------------------------------- |
| SPX_MFS_118200525_2_pep | (SEQ ID NO. 8763) | ------------------------------------------------- |
| SPX_MFS_117961287_cdna.pep | (SEQ ID NO. 8757) | FSRFLDDQIERIVLFLLQQQGHLASRIEKLAEKRTALLEEYDISQVYQLH |
| SPX_MFS_117961287_2_cdna.pep | (SEQ ID NO. 8759) | ------------------------------------------------- |

| | | |
|---|---|---|
| SPX_MFS_126116193_plus_est_sti | (SEQ ID NO. 8766) | EAYREVGIDLIKLLKFVDLNATGIRKILKKFDKRFGYRFTDYYVTSRSNH |
| fs_SPX_MFS_126116193_plus_est_ | (SEQ ID NO. 8765) | EAYREVGINLIKLLKFVDLNATGIRKILKKFDKRFGYRFTDYYVTSRSNH |
| SPX_MFS_118200525_cdna.pep | (SEQ ID NO. 8761) | ------------------------------------------------- |
| SPX_MFS_118200525_2_pep | (SEQ ID NO. 8763) | ------------------------------------------------- |
| SPX_MFS_117961287_cdna.pep | (SEQ ID NO. 8757) | DAYREVGLDLIKLLRFVDVNATGIRKILKKFDKRFGYKFTDYYVTTRANH |
| SPX_MFS_117961287_2_cdna.pep | (SEQ ID NO. 8759) | ------------------------------------------------- |

| | | |
|---|---|---|
| SPX_MFS_126116193_plus_est_sti | (SEQ ID NO. 8766) | PYSQLQQVFKHVGVGAVVGALSRNLAELQERQGSYLSIYDQPSSALKDPI |
| fs_SPX_MFS_126116193_plus_est_ | (SEQ ID NO. 8765) | PYSQLQQVFKHVGVGAVVGALSRNLAELQERQGSYLSIYDQPSSALKDPI |
| SPX_MFS_118200525_cdna.pep | (SEQ ID NO. 8761) | ------------------------------------------------- |
| SPX_MFS_118200525_2_pep | (SEQ ID NO. 8763) | ------------------------------------------------- |
| SPX_MFS_117961287_cdna.pep | (SEQ ID NO. 8757) | PYSQLQQVFKQVGIVAVVGALSRNLEYLQHHEGSFVSIYDRPAVTLKDPI |
| SPX_MFS_117961287_2_cdna.pep | (SEQ ID NO. 8759) | ------------------------------------------------- |

| | | |
|---|---|---|
| SPX_MFS_126116193_plus_est_sti | (SEQ ID NO. 8766) | IDMINSPVDKLTRSTNFLRFLGQHALIVDEESPSTAGEEIEDQKYHFMS |
| fs_SPX_MFS_126116193_plus_est_ | (SEQ ID NO. 8765) | IDMINSPVDKLTRSTNFLRFLGQHALIVDEESPSTAGEEIEDQKYHFMS |
| SPX_MFS_118200525_cdna.pep | (SEQ ID NO. 8761) | IDMINSSVDKLTRSTNFLRFLGQHAMIVDEESPSTAGEEIEDQKYHFMS |
| SPX_MFS_118200525_2_pep | (SEQ ID NO. 8763) | ------------------------------------------------ |
| SPX_MFS_117961287_cdna.pep | (SEQ ID NO. 8757) | ------------------------------------------------ |
| SPX_MFS_117961287_2_cdna.pep | (SEQ ID NO. 8759) | IDQVNHAVQKLTHATNFMQFLGQHALIVQEDAES-ESEDLVGDQSYHFMS |

FIGURE 11 (continued)

```
SPX_MFS_126116193_plus_est_sti   (SEQ ID NO. 8766)   ------------------------------------
fs_SPX_MFS_126116193_plus_est_   (SEQ ID NO. 8765)   ------------------------------------
SPX_MFS_118200525_cdna.pep       (SEQ ID NO. 8761)   LMLNLVNTFLYMVNTYIIVP----------------
SPX_MFS_118200525_2_pep          (SEQ ID NO. 8763)   LMLNLVNTFLYMVNTYIIVPTADDYSVSLGAASTVCGVVIGSMTVAQIFS
SPX_MFS_117961287_cdna.pep       (SEQ ID NO. 8757)   ------------------------------------
SPX_MFS_117961287_2_cdna.pep     (SEQ ID NO. 8759)   LVLNLVNTFLYMVNTYIIVPTADDYAVSLGAATVCGIIIGSMAVAQVFS SPX_MFS_126116193_plus_est_sti   (SEQ ID NO. 8766)   ----------------------------------------MTIQ
fs_SPX_MFS_126116193_plus_est_   (SEQ ID NO. 8765)   --------------------------------------------
SPX_MFS_118200525_cdna.pep       (SEQ ID NO. 8761)   -----------------------------------TADDYX
SPX_MFS_118200525_2_pep          (SEQ ID NO. 8763)   SIYFSAWSNKSYFKPLVFSSIVLFLGNICYAMAYDMKSLTVLIIGRLLCG
SPX_MFS_117961287_cdna.pep       (SEQ ID NO. 8757)   --------------------------------------------
SPX_MFS_117961287_2_cdna.pep     (SEQ ID NO. 8759)   SVYFSAWSNKSYFKPLVFSSIMLFLGNLLYALAYDLNSLIVLLTGRLLCG
                                                                                                    MCR SPX_MFS_126116193_plus_est_sti   (SEQ ID NO. 8766)   MGSARAVNRRYISDCVPARIRMQASAGFVSASALGMACGPALAGLLQWKF
fs_SPX_MFS_126116193_plus_est_   (SEQ ID NO. 8765)   MGSARAVNRRYISDCVPARIRMQASAGFVSASALGMACGPALAGLLQWKF
SPX_MFS_118200525_cdna.pep       (SEQ ID NO. 8761)   MGSARAVNRRYISDCVPARIRMQASAGFVSASALGMACGPALAGLLQWKF
SPX_MFS_118200525_2_pep          (SEQ ID NO. 8763)   MGSARAVNRRYISDCVPARIRMQASAGFVSASALGMACGPALAGLLQWKF
SPX_MFS_117961287_cdna.pep       (SEQ ID NO. 8757)   LGSARAVNRRYISDCVPLKMRIQASAGFVSASALGMACGPALAGFLQIKF
SPX_MFS_117961287_2_cdna.pep     (SEQ ID NO. 8759)   LGSARAVNRRYISDCVPLKMRIQASAGFVSASALGMACGPALAGFLQIKF
                                                     :************  : :*:**************************:**

SPX_MFS_126116193_plus_est_sti   (SEQ ID NO. 8766)   KIYMVTFNQSTLPGWVMAVAWLLYLIIWLWVSFKEPNRATEVNEAPQNPAS
fs_SPX_MFS_126116193_plus_est_   (SEQ ID NO. 8765)   KIYMVTFNQSTLPGWVMAVAWLLYLIIWLWVSFKEPNRATEVNEAPQNPAS
SPX_MFS_118200525_cdna.pep       (SEQ ID NO. 8761)   KVYMVTFNQSTLPGWVMAVAWLLYLIIWLWVSFKEPNRATEVNEAPQNPAS
SPX_MFS_118200525_2_pep          (SEQ ID NO. 8763)   KVYMVTFNQSTLPGWVMAVAWLLYLIIWLWFSFKEPNRATEVNEAPQNPAS
SPX_MFS_117961287_cdna.pep       (SEQ ID NO. 8757)   KIYSLSFNQSTLPGWVMCISWLIYLLWLWLTFKEPEHFTKTLVNEQPSES
SPX_MFS_117961287_2_cdna.pep     (SEQ ID NO. 8759)   KIYSLSFNQSTLPGWVMCISWLIYLLWLWLTFKEPEHFTKTLVNEQPSES
                                                     *:*::*********** : ** :**:******:. *: .:**********  *

SPX_MFS_126116193_plus_est_sti   (SEQ ID NO. 8766)   GQTVDIGQVENGLAQPLIMDSVDKQNEDEDEVDESEEAADDSRKPATSI
fs_SPX_MFS_126116193_plus_est_   (SEQ ID NO. 8765)   GQTVDIGQVENGLAQPLIMDSVDKQNEDEDEVDESEEAADDSRKPATSI
SPX_MFS_118200525_cdna.pep       (SEQ ID NO. 8761)   GQTVDIGRLENGIAQPLLKDSVDKQNEDEDE-VDDIEETADDSRKPATSI
SPX_MFS_118200525_2_pep          (SEQ ID NO. 8763)   GQTVDIGRLENGIAQPLLKDSVDKQNEDEDE-VDDIEETADDSRKPATSI
SPX_MFS_117961287_cdna.pep       (SEQ ID NO. 8757)   GRQGNS-NLEAGLAEPLLQG-IERRQDENSEVNDDTEVESESSHEPATSI
SPX_MFS_117961287_2_cdna.pep     (SEQ ID NO. 8759)   GRQGNS-NLEAGLAEPLLQG-IERRQDENSEVNDDTEVESESSHEPATSI
                                                     *:  .  :*  *:* *::  :     ::.   *    *:.*  ******
```

FIGURE 11 (continued)

```
SPX_MFS_126116193_plus_est_sti   (SEQ ID NO. 8766)   GSAYRLLTPSVKVQLLIYFMLKYAMEILLSESSVITNHYFSWNTSAVAIF
fs_SPX_MFS_126116193_plus_est_   (SEQ ID NO. 8765)   GSAYRLLTPSVKVQLLIYFMLKYAMEILLSESSVITNHYFSWNTSAVAIF
SPX_MFS_118200525_cdna.pep       (SEQ ID NO. 8761)   GSAYRLLTPSVKVQLLIYFMLKYAMEILLSESSVITNHYFSWNTSAVAIF
SPX_MFS_118200525_2_pep          (SEQ ID NO. 8763)   GSAYRLLTPSVKVQLLIYFMLKYAMEILLSESSVTTYYFSWSTSAVAIF
SPX_MFS_117961287_cdna.pep       (SEQ ID NO. 8757)   ASAYRLLTPSVKAQLLIYFMLKYAMEILLSESSVTTYYFSWSTSAVAIF
SPX_MFS_117961287_2_cdna.pep     (SEQ ID NO. 8759)   ASAYRLLTPSVKAQLLIYFMLKYAMEILLSESSVTTYYFSWSTSAVAIF
                                                     .********** .****************.****:.:*********

SPX_MFS_126116193_plus_est_sti   (SEQ ID NO. 8766)   LAILGLTVLPVNAVVGTYISNMFEDRQLLMVSQITLLVGIIFSFKVTSTY
fs_SPX_MFS_126116193_plus_est_   (SEQ ID NO. 8765)   LAILGLTVLPVNAVVGTYISNMFEDRQLLMVSQITLLVGIIFSFKVTSTY
SPX_MFS_118200525_cdna.pep       (SEQ ID NO. 8761)   LAILGLTVLPVNAVVGTYISNMFEDRQLLMVSQITLLVGIIFSFKVTSTY
SPX_MFS_118200525_2_pep          (SEQ ID NO. 8763)   LAILGLTVLPVNAVVGTYISNMFEDRQLLMVSQITLLVGIIFSFKVTSTY
SPX_MFS_117961287_cdna.pep       (SEQ ID NO. 8757)   LAILGLTVLPVNAIVGSYVTNLFEDRQILLASEVMLIGIIMSFCFTPHY
SPX_MFS_117961287_2_cdna.pep     (SEQ ID NO. 8759)   LAILGLTVLPVNAIVGSYVTNLFEDRQILLASEVMLIGIIMSFCFTPHY
                                                     *************:**.*:.:*****:**:**:*:***:.**  *.*

SPX_MFS_126116193_plus_est_sti   (SEQ ID NO. 8766)   SVVQYVVSALVTFVSAEVLEGVNLSLLSSVMSSRLSRGTYNGGLLSTEAG
fs_SPX_MFS_126116193_plus_est_   (SEQ ID NO. 8765)   SVVQYVVSALVTFVSAEVLEGVNLSLLSSVMSSRLSRGTYNGGLLSTEAG
SPX_MFS_118200525_cdna.pep       (SEQ ID NO. 8761)   YVVQYVVSALVTFVSAEVLEGVNLSLLSSVMSSRLSRGTYNGGLLSTEAG
SPX_MFS_118200525_2_pep          (SEQ ID NO. 8763)   YVVQYVVSALVTFVFAEVLEGVNLSLLSRVMSSRLSRGTYNGGLLSTEAG
SPX_MFS_117961287_cdna.pep       (SEQ ID NO. 8757)   SIPQYVLSAFITFVFAEVLEGVNLSLLSRVMSSRLSRGTYNGGLLSTEAG
SPX_MFS_117961287_2_cdna.pep     (SEQ ID NO. 8759)   SIPQYVLSAFITFVFAEVLEGVNLSLLSRVMSSRLSRGTYNGGLLSTEAG
                                                     :  ***:** :***.***************  *****************

SPX_MFS_126116193_plus_est_sti   (SEQ ID NO. 8766)   TLARVVADCTITAAGYLGVGKLLNVTLLPSLVICVASIACTFLTYNSLF
fs_SPX_MFS_126116193_plus_est_   (SEQ ID NO. 8765)   TLARVVADCTITAAGYLGVGKLLNVTLLPSLVICVASIACTFLTYNSLF
SPX_MFS_118200525_cdna.pep       (SEQ ID NO. 8761)   TLARVVADCTITAAGYLGVGKLLNVTLLPSLVICVASIACTFLTYNSLF
SPX_MFS_118200525_2_pep          (SEQ ID NO. 8763)   TLARVVADCTITAAGYLGVGKLLNVTLLPSLVICVASIACTFLTYNSLF
SPX_MFS_117961287_cdna.pep       (SEQ ID NO. 8757)   TLARVVADATITAAGYLGTDLLNVTLLPSLVICIVSIAAALYTYNNLY
SPX_MFS_117961287_2_cdna.pep     (SEQ ID NO. 8759)   TLARVVADATITAAGYLGTDLLNVTLLPSLVICIVSIAAALYTYNNLY
                                                     ********:.*********.:***********:.:**:: *****.*
```

FIGURE 13

```
ctgcagcccactgctcctccacggcgtggatcttctccaacgcggcattcacgttcgcgcgtatgcgat
ggaggggaaactaggcggaagaaggcattggtggcggcattggatttctggacggcttcggaaaggagt
ggcgtgggaggtcaccgtgtggacgaacatgtggttgggctacgtgggggtgggcacggaggtggacta
gtggtggaagacagcgagctcgtcggcgagggaggttggaactgggacgcggtagccgatacccgtgcgc
acggccggtagcaagaaatggcaagggaaggatgcggcacacggtgaagtgatggaccgggtctgcac
atttatggccccaggaagcaagggaacgaccccggcaaactcctaggcgagagaagcggtccagccac
aaccacccaaggaagaagacccggcctgagcagtaaaacaataccggaggaggaacacaagaaggtaga
gcaccaacacccaacttggtgatgctcgccaacaccaccatcgctctcatccaagaaaggtacgatcaa
gattaatcccttagattagtctaggaccccttacttcatcgaggttagattggattggccttctagagt
tttactaatggcattggagccaacctaagaaccctagattccctaatccaacaagttagagtcaagaat
gtctctcgacccataattaagaacccacatagggatttaaagaggtagaagaagagcagtaggggagcg
agtggtagccctaacccaaacacccagaattagcagaaaggggttcgagttaggtaaccctaacactaa
atccccaataactcagaggaaggagatggaccgtagagggactcaagttagattaaactaaccctaatt
cccaagttaaggaaaagatcactcgggggagggggttagggtgttaaatcctaccccaatccccaaa
tcattagaaagggaaacaacatagaggaccttcagttaggtaaccctaacccttaatcccaaatcatca
aaaggaactgaggacaaccctaaattccaaccttccagaaccttacaaggggctcaggatggagatcca
aagccccaaagcacaggtcctgaacatcgagacaaattagggttttgaaccctaaatccttccccaaat
catataaagaaatgtaccaaggcggccggagagtgcaaattgtttttatagagacaactatcctttct
acgtgccactgtaactctattaaatctatttgtacagtatgttgtaaattccaatcatctcagaaaaca
tatttatagagagacgtctctcatttctagtcccctctataaatctcatttctaggaacagttacaatg
tgtttggtttgaggttaaagtgggatgagtcaggggcgacaccgtctcctcatttttttgggatcatgc
cgccatcaaaattactacggggtttatctcgcccctacgtgactctcatccaaatattattagaactat
ggtcgtcctatttatccctccatatatatctaaccaaacacacccggccagccacctatacaaatcat
ttatttacagtaaggacgactggcctacacgagacaaggccgccgtctcttagatcttaggtgctgttt
ggttcacatatttataacgcaatgggtaactgataacgttaaatcatgtttgttttagtccaaccgtaa
tcagataccacactaaaaattgataccagcctattcaaatttgttaccgccagtaatcgagcgtaaact
attaccattaccatttgcgttacatttcttgaaccaaacaacaccttagttcgtagcagtggatcaaac
gccggtttcatccgattgctattccccaattataataaatctccatcgtggtcaacattaaaaaaaaa
ctccgtcgaccctagtactgctactcgctagaattttatttgtcttctagacgagttactgatgtttg
cttgctggcccatctaatccgcaggagaattgaagaagcaagcgctgttgtcctgtcacacagctagct
cggtccctctatcattgttgaatggtttattcccggggaatatgccctcgctcctctggcatcatccgc
agcatatatcctccgtctcgtcttccacctcggATCAGGTAGGCGCGGCGCGGACCGCAACACGCCAGC
TTTCTTGCTCTTGTCTCTAAGCAGCAGCAGCTTCCTGTCTCTCCAGCCACCATTCCATTCTCGCTCCTT
GGTAATGAGGCTGGCTAGCCAGCTAATGCAGCTCCGAACCTGTTTTGTTGGTGGTCATTTAACCATGCA
TGCTTCGATCGATGGATTGGTGCATGCATGGATTATTGCATAGTGTGATGCATGTGGCGCATCAGTGCA
TGGTTAGATGACCATCAGCAAACATGTTCTTGAGGCATGCAAGTTCTCTAGCTACACATATCAGAGATC
GATCACCACTGCGGCGCCATGGCTACTTAATTGAAATGGAGGTTTGCATTTCTCCGAACCCGGATGTCG
TGATTCTGCTTCCGTTCTTGATCCAGGATCTTCCGGTCTTGTTCCCACCATTACTTTCCTTAGGAAACT
GGAATGGTTTCAACCTTAATTTGTTTATGTGTGTGTGCACATGCAGCGTGTGTTTCATATGGAGATCGG
TGCACTCACCTTGTAGCTTTAGCTTGCATCCCCTTCGCTAACAGAGAGTAAGATATCTTAGTCCTCTCG
CCATCTCTCTAAACATATACGTATCA
```

Zm-miRMON18 (SEQ ID NO. 8800)

FIGURE 15
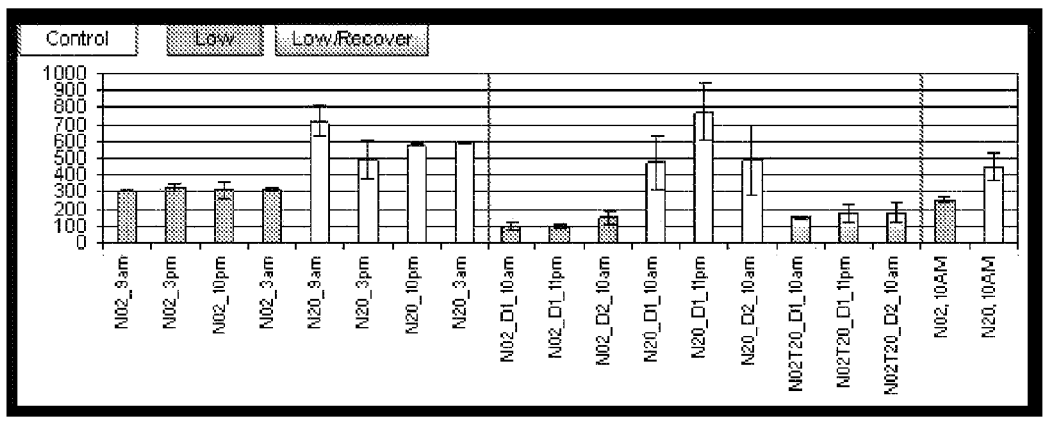
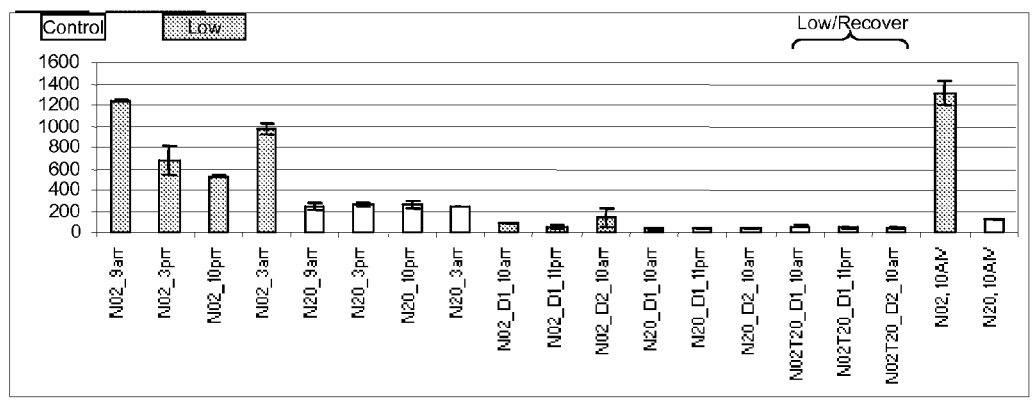

FIGURE 17
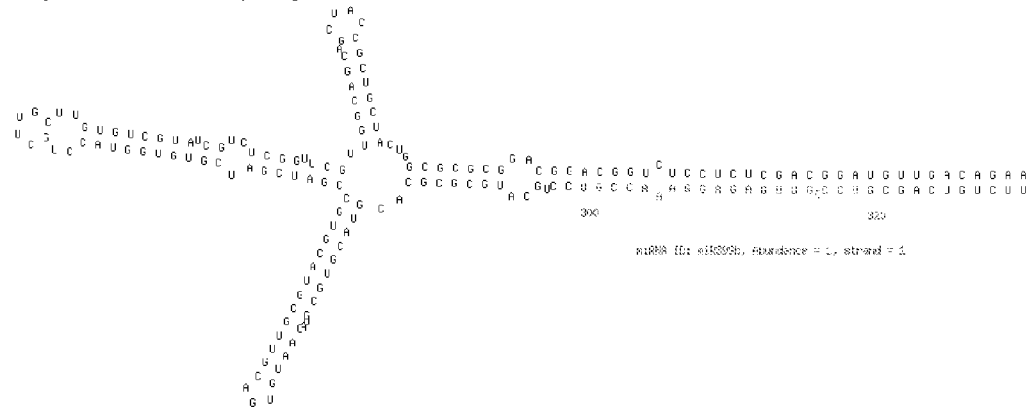
A
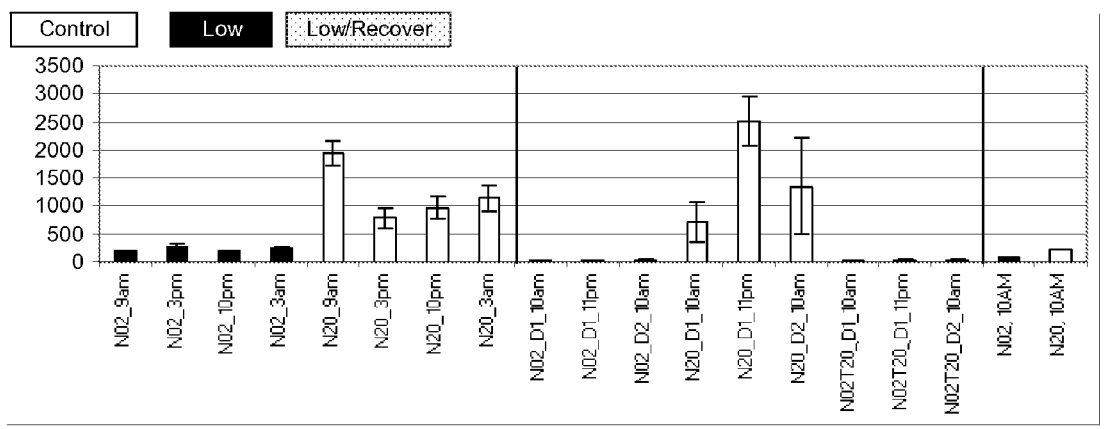
B

FIGURE 18

FIGURE 19
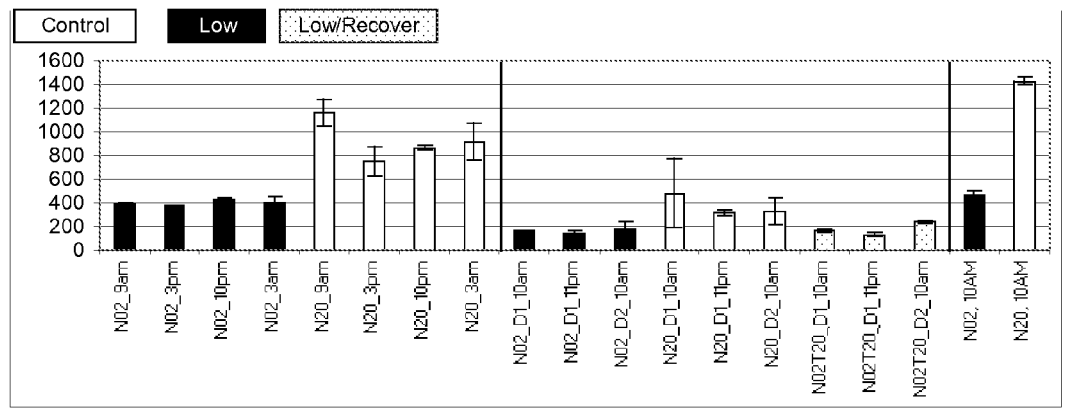
A
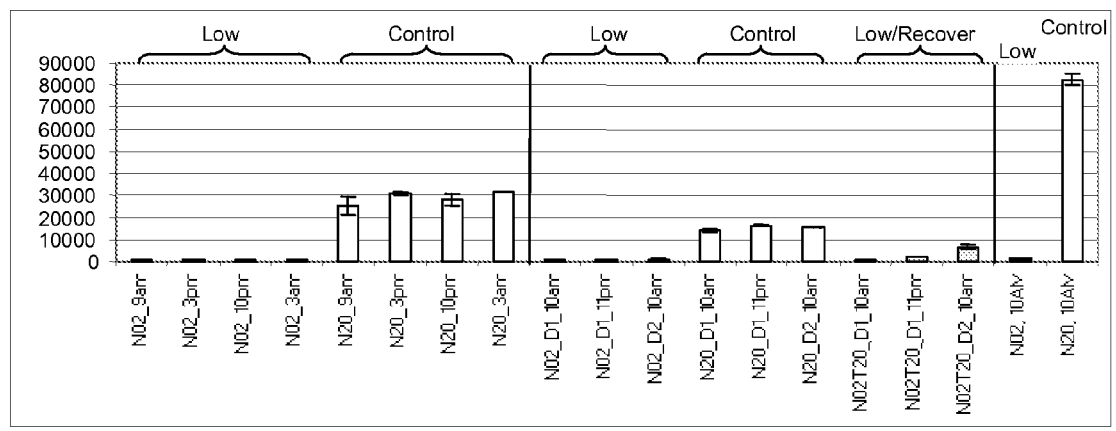
B
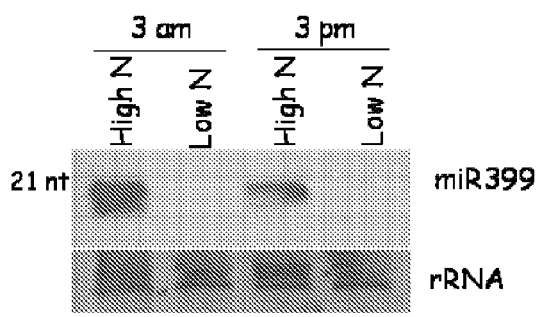
C
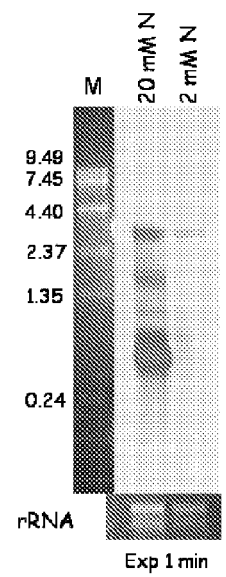
D

FIGURE 20
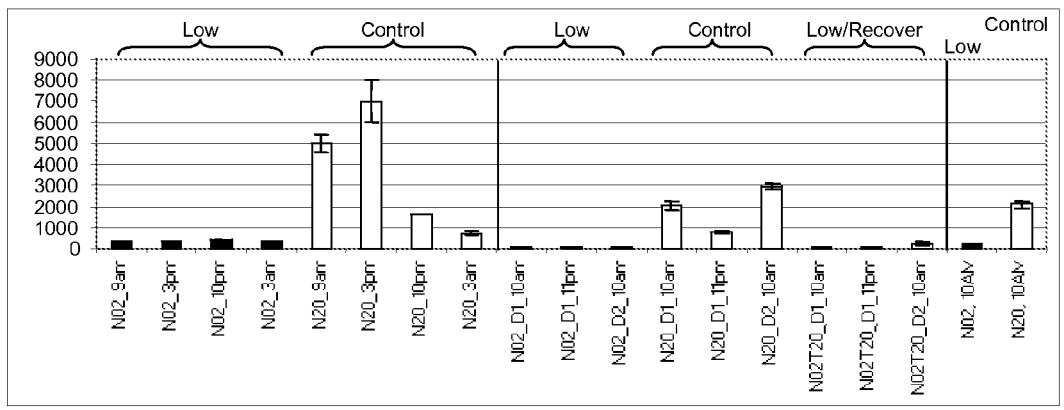
A
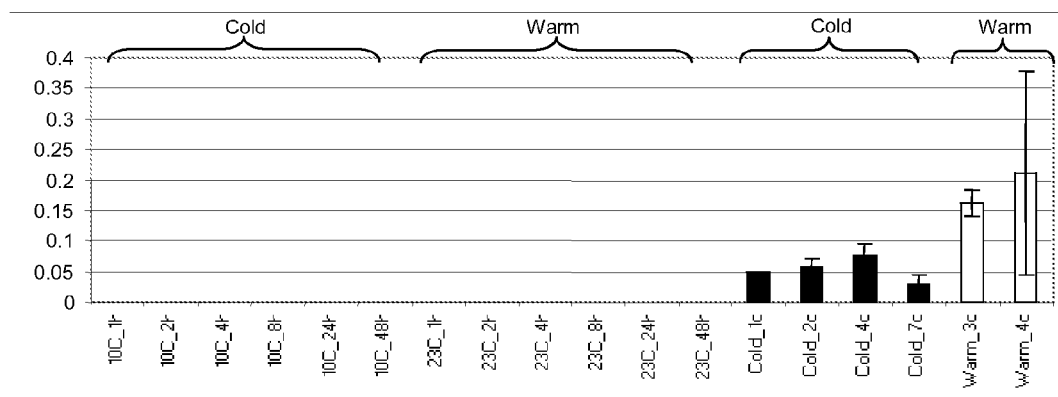
B
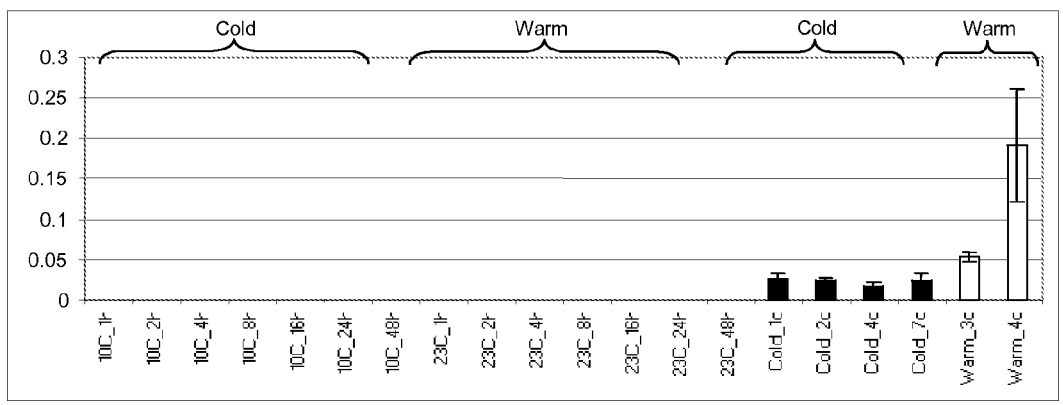
C

FIGURE 21
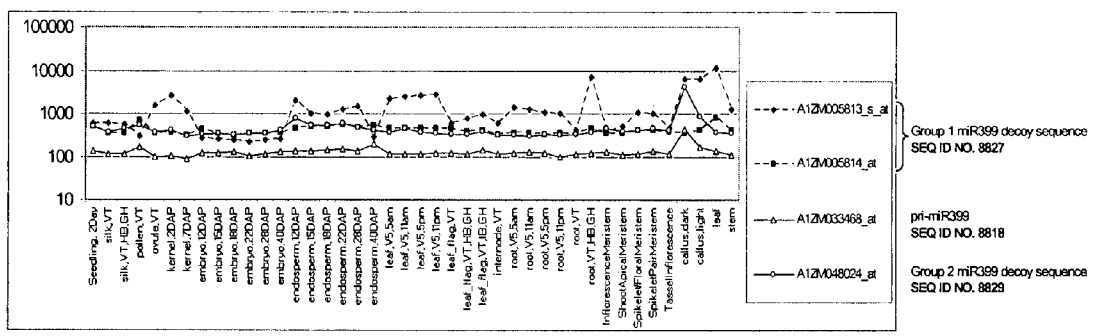
A
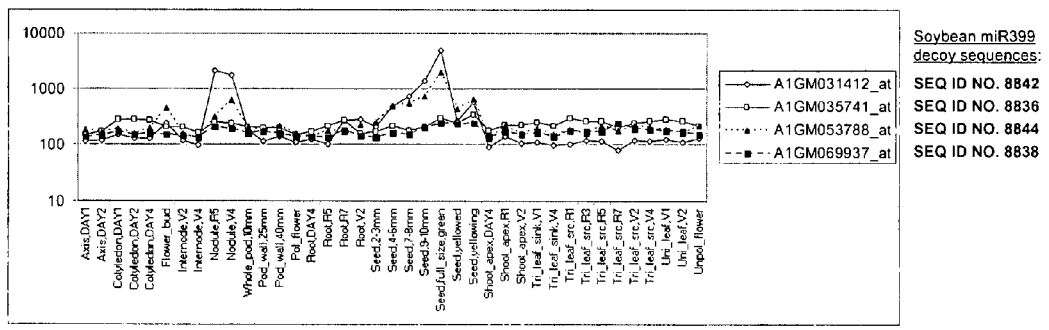
B

FIGURE 22
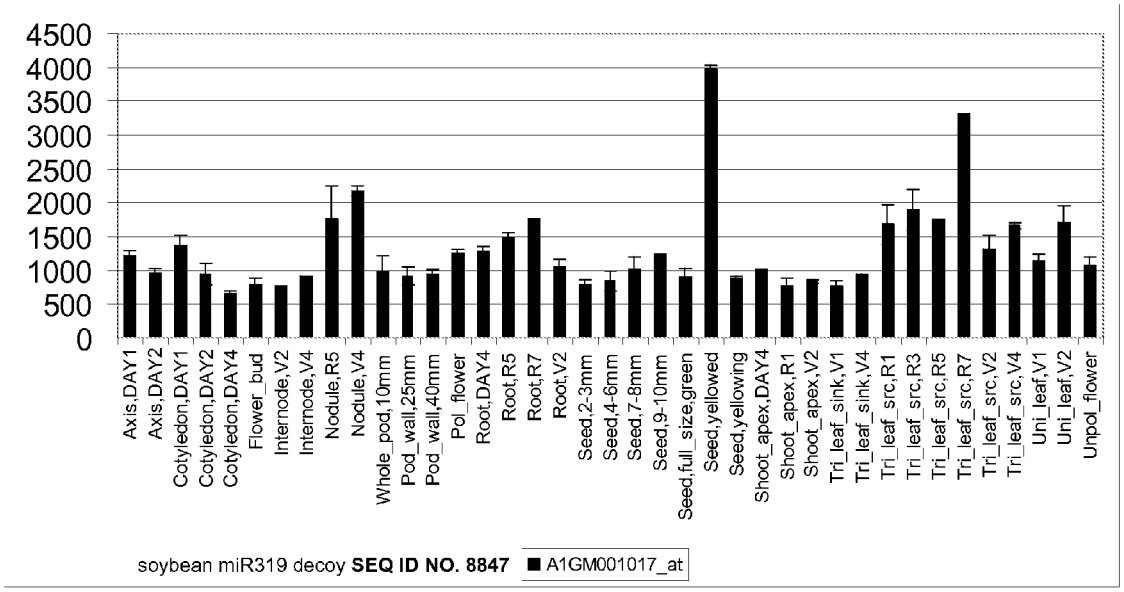
A
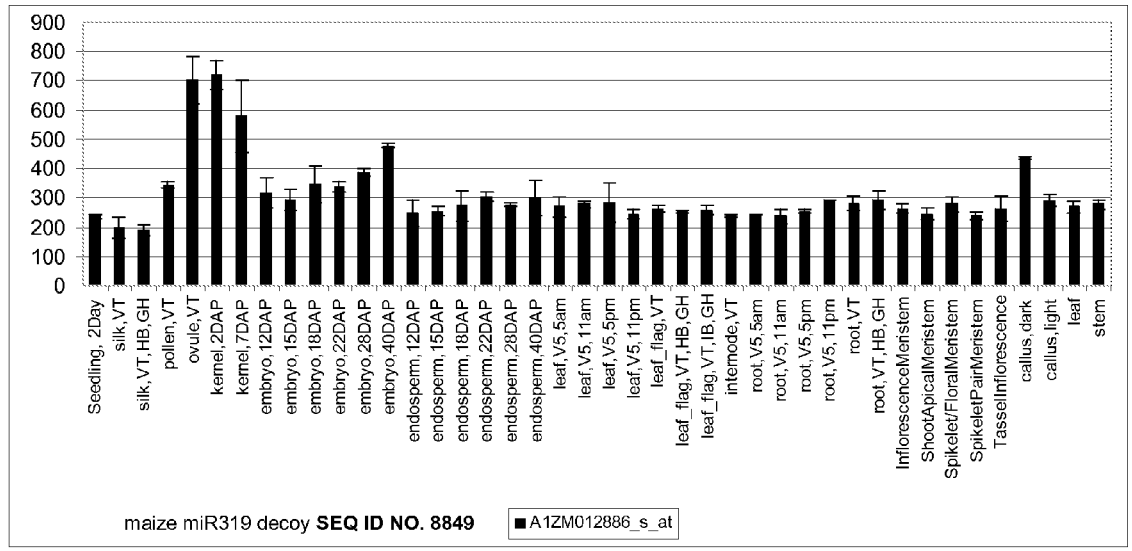
B

PLANT MICRORNAS AND METHODS OF USE THEREOF

CROSS-REFERENCE TO RELATED APPLICATIONS AND INCORPORATION OF SEQUENCE LISTINGS

This application claims the benefit of priority of U.S. Provisional Patent Applications 60/851,187, filed 12 Oct. 2006, 60/908,826, filed 29 Mar. 2007, and 60/969,195, filed 31 Aug. 2007, which are incorporated by reference in their entirety herein. The sequence listing that is contained in the file named "38-21__54769_D.txt", created on 11 Oct. 2007, and which is 2209 kilobytes (measured in operating system MS-Windows), is submitted in computer readable form on three compact discs (CD-R) identified as "Copy 1", "Copy 2", and "CRF", which are filed herewith and incorporated herein by reference. The sequence listings that are contained in the file named "38-21(54769)A.txt" (734 kilobytes measured in operating system MS-Windows, created on Oct. 11, 2006, and filed in computer readable form on three compact discs identified as "Copy 1", "Copy 2", and CRF, with U.S. Provisional Patent Application 60/851,187 on 12 Oct. 2006), the file named "38-21__54769_B.txt" (1517 kilobytes measured in operating system MS-Windows, created on 29 Mar. 2007, and filed by electronic submission with U.S. Provisional Patent Application 60/908,826 on 29 Mar. 2007), and the file named "38-21__54769_C.txt" (2369 kilobytes measured in operating system MS-Windows, created on 30 Aug. 2007, and filed by electronic submission with U.S. Provisional Patent Application 60/969,195 on 31 Aug. 2007), and the substitute computer readable form of the sequence listing contained in the file named "38-21__54769_Dcorrected.txt", created on 22 Jan. 2008, which is 2209 kb measured in operating system MS-Windows, electronically filed via EFS-Web on 23 Jan. 2008, are incorporated by reference in their entirety herein.

FIELD OF THE INVENTION

This invention discloses novel microRNAs and microRNA precursors, recombinant DNA constructs including such novel miRNAs, miRNA precursors, and miRNA recognition sites corresponding to the miRNAs. Included are novel miRNA and miRNA precursors that exhibit abiotic-stress-responsive expression. Further provided are miRNA decoy sequences, non-natural transgenic plant cells, plants, and seeds containing in their genome a recombinant DNA construct of this invention, and methods of controlling gene expression using recombinant DNA constructs of this invention.

BACKGROUND OF THE INVENTION

Several cellular pathways involved in RNA-mediated gene suppression have been described, each distinguished by a characteristic pathway and specific components. See, for example, the reviews by Brodersen and Voinnet (2006), *Trends Genetics,* 22:268-280, and Tomari and Zamore (2005) *Genes & Dev.,* 19:517-529. The siRNA pathway involves the non-phased cleavage of a double-stranded RNA ("RNA duplex") to small interfering RNAs (siRNAs). The microRNA pathway involves microRNAs (miRNAs), non-protein coding RNAs generally of between about 19 to about 25 nucleotides (commonly about 20-24 nucleotides in plants) that guide cleavage in trans of target transcripts, negatively regulating the expression of genes involved in various regulation and development pathways. Plant miRNAs have been defined by a set of characteristics including a stem-loop precursor that is processed by DCL1 to a single specific ~21-nucleotide miRNA, expression of a single pair of miRNA and miRNA* species from the RNA duplex with two-nucleotide 3' overhangs, and silencing of specific targets in trans. See Bartel (2004) *Cell,* 116:281-297; Kim (2005) *Nature Rev. Mol. Cell. Biol.,* 6:376-385; Jones-Rhoades et al. (2006) *Annu. Rev. Plant Biol.,* 57:19-53; Ambros et al. (2003) *RNA,* 9:277-279. In the trans-acting siRNA (ta-siRNA) pathway, miRNAs serve to guide in-phase processing of siRNA primary transcripts in a process that requires an RNA-dependent RNA polymerase for production of an RNA duplex; trans-acting siRNAs are defined by lack of secondary structure, an miRNA target site that initiates production of double-stranded RNA, requirements of DCL4 and an RNA-dependent RNA polymerase (RDR6), and production of multiple perfectly phased ~21-nucleotide small RNAs with perfectly matched duplexes with two-nucleotide 3' overhangs (see Allen et al. (2005) *Cell,* 121:207-221).

MicroRNAs (miRNAs) are non-protein coding RNAs, generally of between about 19 to about 25 nucleotides (commonly about 20-24 nucleotides in plants), that guide cleavage in trans of target transcripts, negatively regulating the expression of genes involved in various regulation and development pathways (Bartel (2004) *Cell,* 116:281-297). In some cases, miRNAs serve to guide in-phase processing of siRNA primary transcripts (see Allen et al. (2005) *Cell,* 121:207-221).

Some microRNA genes (MIR genes) have been identified and made publicly available in a database ("miRBase", available on line at microrna.sanger.ac.uk/sequences). The applicants have disclosed novel MIR genes, mature miRNAs, and miRNA recognition sites in U.S. patent application Ser. No. 11/303,745, filed 15 Dec. 2005, which are incorporated by reference herein. Additional MIR genes and mature miRNAs are also described in U.S. Patent Application Publications 2005/0120415 and 2005/144669A1, which are incorporated by reference herein. MIR genes have been reported to occur in intergenic regions, both isolated and in clusters in the genome, but can also be located entirely or partially within introns of other genes (both protein-coding and non-protein-coding). For a recent review of miRNA biogenesis, see Kim (2005) *Nature Rev. Mol. Cell. Biol.,* 6:376-385. Transcription of MIR genes can be, at least in some cases, under promotional control of a MIR gene's own promoter. MIR gene transcription is probably generally mediated by RNA polymerase II (see, e.g., Aukerman, and Sakai (2003) *Plant Cell,* 15:2730-2741; Parizotto et al. (2004) *Genes Dev.,* 18:2237-2242), and therefore could be amenable to gene silencing approaches that have been used in other polymerase II-transcribed genes. The primary transcript (which can be polycistronic) is termed a "pri-miRNA", a miRNA precursor molecule that can be quite large (several kilobases) and contains one or more local double-stranded or "hairpin" regions as well as the usual 5' "cap" and polyadenylated tail of an mRNA. See, for example, FIG. 1 in Kim (2005) *Nature Rev. Mol. Cell. Biol.,* 6:376-385.

In plant cells, microRNA precursor molecules are believed to be largely processed in the nucleus. The pri-miRNA is processed to a shorter miRNA precursor molecule that also includes a stem-loop or fold-back structure and is termed the "pre-miRNA". In plants, miRNAs and siRNAs are formed by distinct DICER-like (DCL) enzymes, and in *Arabidopsis* a nuclear DCL enzyme (DCL1) is believed to be required for mature miRNA formation; see, for example, Ambros et al. (2003) *RNA,* 9:277-279, and Xie et al. (2004) *PLoS Biol.,* 2:642-652. Additional reviews on microRNA biogenesis and function are found, for example, in Bartel (2004) *Cell*, 1116: 281-297; Murchison and Hannon (2004) *Curr. Opin. Cell Biol.*, 16:223-229; and Dugas and Bartel (2004) *Curr. Opin. Plant Biol.*, 7:512-520. MicroRNAs can thus be described in terms of RNA (e.g., RNA sequence of a mature miRNA or a miRNA precursor RNA molecule), or in terms of DNA (e.g., DNA sequence corresponding to a mature miRNA RNA sequence or DNA sequence encoding a MIR gene or fragment of a MIR gene or a miRNA precursor).

MIR gene families are estimated to account for 1% of at least some genomes and capable of influencing or regulating expression of about a third of all genes (see, e.g., Tomari et al. (2005) *Curr. Biol.*, 15:R61-64; G. Tang (2005) *Trends Biochem. Sci.*, 30:106-14; Kim (2005) *Nature Rev. Mol. Cell. Biol.*, 6:376-385). Because miRNAs are important regulatory elements in eukaryotes, including animals and plants, transgenic suppression of miRNAs could, for example, lead to the understanding of important biological processes or allow the manipulation of certain pathways (e.g., regulation of cellular differentiation, proliferation, and apoptosis) useful, for example, in biotechnological applications. See, for example, O'Donnell et al. (2005) *Nature*, 435:839-843; Cai et al. (2005) *Proc. Natl. Acad. Sci. USA*, 102:5570-5575; Morris and McManus (2005) *Sci. STKE*, pe41 (stke.sciencemag.org/cgi/reprint/sigtrans;2005/297/pe41.pdf). MicroRNA (MIR) genes have identifying characteristics, including conservation among plant species, a stable foldback structure, and processing of a specific miRNA/miRNA* duplex by Dicer-like enzymes (Ambros et al. (2003) *RNA*, 9:277-279). These characteristics have been used to identify miRNAs and their corresponding genes in plants (Xie et al. (2005) *Plant Physiol.*, 138:2145-2154; Jones-Rhoades and Bartel (2004) *Mol. Cell*, 14:787-799; Reinhart et al. (2002) *Genes Dev.*, 16:1616-1626; Sunkar and Zhu (2004) *Plant Cell*, 16:2001-2019). Publicly available microRNA genes are catalogued at miRBase (Griffiths-Jones et al. (2003) *Nucleic Acids Res.*, 31:439-441).

MiRNAs are expressed in very specific cell types in *Arabidopsis* (see, for example, Kidner and Martienssen (2004) *Nature*, 428:81-84, Millar and Gubler (2005) *Plant Cell*, 17:705-721). Suppression can be limited to a side, edge, or other division between cell types, and is believed to be required for proper cell type patterning and specification (see, e.g., Palatnik et al. (2003) *Nature*, 425:257-263). Suppression of a GFP reporter gene containing an endogenous miR171 recognition site was found to limit expression to specific cells in transgenic *Arabidopsis* (Parizotto et al. (2004) *Genes Dev.*, 18:2237-2242). Recognition sites of miRNAs have been validated in all regions of an mRNA, including the 5' untranslated region, coding region, and 3' untranslated region, indicating that the position of the miRNA target site relative to the coding sequence may not necessarily affect suppression (see, e.g., Jones-Rhoades and Bartel (2004). *Mol. Cell*, 14:787-799, Rhoades et al. (2002) *Cell*, 110:513-520, Allen et al. (2004) *Nat. Genet.*, 36:1282-1290, Sunkar and Zhu (2004) *Plant Cell*, 16:2001-2019).

The mature miRNAs disclosed herein are processed from MIR genes that generally belong to canonical families conserved across distantly related plant species. These MIR genes and their encoded mature miRNAs are also useful, e.g., for modifying developmental pathways, e.g., by affecting cell differentiation or morphogenesis (see, for example, Palatnik et al. (2003) *Nature*, 425:257-263; Mallory et al. (2004) *Curr. Biol.*, 14:1035-1046), to serve as sequence sources for engineered (non-naturally occurring) miRNAs that are designed to silence sequences other than the transcripts targetted by the naturally occurring miRNA sequence (see, for example, Parizotto et al. (2004) *Genes Dev.*, 18:2237-2242; also see U.S. Patent Application Publications 2004/3411A1 and 2005/0120415, incorporated by reference herein), and to stabilize dsRNA. A MIR gene itself (or its native 5' or 3' untranslated regions, or its native promoter or other elements involved in its transcription) is useful as a target gene for gene suppression (e.g., by methods of the present invention), where suppression of the miRNA encoded by the MIR gene is desired. Promoters of MIR genes can have very specific expression patterns (e.g., cell-specific, tissue-specific, or temporally specific), and thus are useful in recombinant constructs to induce such specific transcription of a DNA sequence to which they are operably linked.

This invention provides novel microRNAs and microRNA precursors identified from plants (including crop plants such as maize, rice, and soybean), as well as recombinant DNA constructs including such novel miRNAs, miRNA precursors, miRNA recognition sites, miRNA decoy sequences, and miRNA promoters corresponding to the miRNAs. Also disclosed and claimed are non-natural transgenic plant cells, plants, and seeds containing in their genome a recombinant DNA construct of this invention. Further provided are methods of gene suppression using recombinant DNA constructs of this invention and methods of providing transgenic plants with desired phenotypes, especially transgenic plants exhibiting increased yield (relative to non-transgenic plants) under abiotic stress conditions including drought, nutrient deficiency, and cold or heat stress.

SUMMARY OF THE INVENTION

In one aspect, this invention provides a recombinant DNA construct including at least one transcribable DNA element for modulating the expression of at least one target gene, wherein the at least one transcribable DNA element is selected from the group consisting of: (a) a DNA element that transcribes to an miRNA precursor with the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, wherein the miRNA precursor includes a contiguous segment of at least 90% of the nucleotides of the maize, rice, or soybean miRNA precursor sequence; (b) a DNA element that transcribes to an engineered miRNA precursor derived from the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819, wherein the engineered miRNA precursor includes a modified mature miRNA; (c) a DNA element that is located within or adjacent to a transgene transcription unit and that is transcribed to RNA including a miRNA recognition site recognized by a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or by a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819; and (d) a DNA element for suppressing expression of an endogenous miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819.

Another aspect of this invention provides a non-natural transgenic plant cell including any of the recombinant DNA constructs of this invention. Further provided is a non-natural transgenic plant containing the non-natural transgenic plant cell of this invention, including plants of any developmental stage, and including a regenerated plant prepared from the non-natural transgenic plant cells disclosed herein, or a progeny plant (which can be an inbred or hybrid progeny plant) of the regenerated plant, or seed of such a non-natural transgenic plant. Also provided and claimed is a transgenic seed having in its genome any of the recombinant DNA constructs provided by this invention.

In a further aspect, this invention provides a method of effecting gene suppression, including the steps of: (a) providing a non-natural transgenic plant including a regenerated plant prepared from a non-natural transgenic plant cell of this invention, or a progeny plant of the regenerated plant; and (b) transcribing the recombinant DNA construct in the non-natural transgenic plant; wherein the transcribing produces RNA that is capable of suppressing the at least one target gene in the non-natural transgenic plant, and whereby the at least one target gene is suppressed relative to its expression in the absence of transcription of the recombinant DNA construct.

In yet another aspect, this invention provides a method of concurrently effecting gene suppression of at least one target gene and gene expression of at least one gene of interest, including the steps of: (a) providing a non-natural transgenic plant including a regenerated plant prepared from the non-natural transgenic plant cell of this invention, or a progeny plant of the regenerated plant, wherein the recombinant DNA construct further includes a gene expression element for expressing the at least one gene of interest; and (b) transcribing the recombinant DNA construct in the non-natural transgenic plant, wherein, when the recombinant DNA construct is transcribed in the non-natural transgenic plant, transcribed RNA that is capable of suppressing the at least one target gene and transcribed RNA encoding the at least one gene of interest are produced, whereby the at least one target gene is suppressed relative to its expression in the absence of transcription of the recombinant DNA construct and the at least one gene of interest is concurrently expressed.

In a further aspect, this invention provides a recombinant DNA construct including a synthetic miRNA-unresponsive transgene sequence that is unresponsive to a given mature miRNA, wherein the synthetic miRNA-unresponsive transgene sequence is: (a) derived from a natively miRNA-responsive sequence by deletion or modification of all native miRNA recognition sites recognized by the given mature miRNA within the natively miRNA-responsive sequence, and (b) is not recognized by the given mature miRNA.

In another aspect, this invention provides a recombinant DNA construct including a promoter of a miRNA that exhibits an expression pattern that is responsive to abiotic stress, for example, a promoter of a miRNA that exhibits an expression pattern characterized by suppression of the miRNA under nutrient stress, a promoter of a miRNA that exhibits an expression pattern characterized by suppression of the miRNA under water stress, or a promoter of a miRNA that exhibits an expression pattern characterized by suppression of the miRNA under temperature stress.

In still a further aspect, this invention provides a recombinant DNA construct that is transcribed to an RNA transcript including at least one miRNA decoy sequence that is recognized and bound by an endogenous mature miRNA but not cleaved; included are transgenic plant cells, plants, and seeds having this construct in their genome, and methods of use of this construct. Related aspects of this invention include recombinant DNA constructs and methods for suppression of endogenous miRNA decoy sequences. Also disclosed are analogous decoy sequences that recognize and bind to other small RNAs (ta-siRNAs, nat-siRNAs, and phased small RNAs) but are not cleaved, thus reducing the activity of the small RNA.

Other specific embodiments of the invention are disclosed in the following detailed description.

BRIEF DESCRIPTION OF THE DRAWINGS

FIGS. 2 and 3 depict non-limiting examples of DNA elements for suppressing expression of a target gene, e.g., an endogenous miRNA, as described in Example 3.

As described in Example 6, FIG. 7A depicts the fold-back structure of a miRMON18 precursor from maize (SEQ ID NO. 3936), FIG. 7B depicts the fold-back structure of a miRMON18 precursor from rice (SEQ ID NO. 1763), and FIG. 7C depicts the fold-back structure of a miR827 precursor from *Arabidopsis thaliana* (SEQ ID NO. 8743). FIG. 7D depicts a comparison of miR827 (SEQ ID NO. 8744) and miRMON18 (SEQ ID NO. 393, SEQ ID NO. 3227, or SEQ ID NO. 8742), with numbered arrows indicating positions 1, 10, and 21 of the mature miRNA; the nucleotide at position 10 is also underlined.

FIG. 8 depicts expression patterns of miRMON18 as determined by Northern blots of the mature miRMON18 21-mer (FIG. 8A) and transcription profiling of the miRMON18 precursor (FIG. 8B), as described in Example 6.

FIG. 9 depicts analysis of expression of the maize miR-MON18 precursor (SEQ ID NO. 3936) in maize tissues from plants grown under water-deficient (drought) (FIG. 9A), cold (FIG. 9B), and nitrogen-deficient conditions (FIG. 9C), as described in Example 6.

FIG. 10 depicts results of northern blots of small RNAs in maize (*Zea mays* var. *LH*244), showing enhanced miR-MON18 expression in maize endospenn and kernel, and strong miRMON18 suppression in leaves induced by nitrogen deficiency (FIG. 10A), and strong miRMON18 expression in leaf tissue under phosphate-sufficient conditions and miRMON18 suppression under phosphate-deficient conditions (FIG. 10B), as described in Example 6.

FIG. 11 depicts a multiple sequence alignment of novel maize miRMON18 target genes containing the maize SPX domain (indicated by underlined sequence, where present) and the maize MFS domain (indicated by sequence in bold text), as described in Example 7.

FIG. 13 depicts a miRMON18 genomic sequence (SEQ ID NO. 8800), as described in Example 8. This shows the miRMON18 transcript in upper-case text at nucleotides 2173-2788 a miRMON18 promoter element in lower-case text at nucleotides 211-2172, a leader element in lower-case text at nucleotides 2173-2308, a canonical TATA box (ending 25 nucleotides upstream of the transcription start site) in underlined lower-case text at nucleotides 2144-2147, the mature miRMON18 as underlined upper-case text at nucleotides 2419-2439, and the miRMON18* as underlined upper-case text at nucleotides 2322-2341.

FIG. 15 depicts the inverse correlation between the miRMON18 precursor (FIG. 15A) and a miRMON18 target (FIG. 15B), as described in Example 9. FIG. 15B shows that the maize sequence MRT4577_36529C (SEQ ID NO. 8788), exhibited higher expression levels under nitrogen-deficient conditions than under nitrogen-sufficient conditions, i.e., an expression pattern opposite to that of the miRMON18 precursor as shown in FIG. 15A.

FIG. 17 depicts the fold-back structures of maize miR399 precursors (FIG. 17A) and depicts results of transcriptional profiling experiments (FIG. 17B), which demonstrate that the Zm-miR399 pri-miRNA is suppressed under nitrogen-deficient conditions (black bars) and is expressed under nitrogen-sufficient conditions (white bars), as described in Example 11.

FIG. 18 depicts alignment of the maize cDNA sequences of the miR399 decoy sequences, with the consensus sequence given as SEQ ID NO. 8834, and reveals at least two groups of genes containing miR399 decoy sequences, as described in Example 11.

FIG. 19 depicts experiments comparing expression of maize miR399 decoy sequences and miR399 precursors as described in Example 11. FIG. 19A shows a transcription profile of group 1 miR399 decoy gene MRT4577_47862C.7 (SEQ ID NO. 8827) and FIG. 19B shows a transcription profile of group 2 miR399 decoy gene MRT4577_36567C.8 (SEQ ID NO. 8829), indicating that these miR399 decoy sequences are down-regulated by nitrogen deficiency. These results were verified by northern blots measuring expression of the mature miR399 (FIG. 19C) and of the miR399 decoy sequence MRT4577_47862C.7 (SEQ ID NO. 8827) (FIG. 19D).

FIG. 20 depicts transcription profiling experiments comparing expression of maize endogenous miR399 decoy cDNA sequences and the corresponding maize miR399 precursors under different temperature conditions, as described in Example 11. Group 2 miR399 decoy gene MRT4577_36567C.8 (SEQ ID NO. 8829) exhibited at least ten-fold or greater higher expression during nitrogen-sufficient conditions in maize leaf, especially during daylight hours (FIG. 20A). This same gene exhibited at least a two-fold down-regulation in root (FIG. 20B) and in shoot (FIG. 20C) after extended exposure to cold.

FIG. 21 depicts expression of endogenous miR399 decoy cDNA sequences in different tissues in both maize and soybean, as described in Example 11. FIG. 21A depicts expression levels of the group 1 maize miR399 decoy sequence SEQ ID NO. 8827 (MRT4577_47862C, represented by probes A1ZM005814_at and A1ZM005813_s_at), and the group 2 maize miR399 decoy sequence SEQ ID NO. 8829 (MRT4577_36567C, represented by probe A1ZM048024_at), as well as of the maize pri-miR399 sequence SEQ ID NO. 8818 (MRT4577_22487C.6 represented by probe A1ZM033468_at). FIG. 21B depicts expression levels of the soybean miR399 decoy sequences SEQ ID NO. 8842 (MRT3847_217257C.2, represented by probe A1GM031412_at), SEQ ID NO. 8844 (MRT3847_236871C.2, represented by probe A1GM053788_at), SEQ ID NO. 8836 (MRT3847_238967C.1, represented by probe A1GM035741_at), and SEQ ID NO. 8838 (MRT3847_241832C.1, represented by probe A1GM069937_at).

FIG. 22 depicts transcription profiling data in various tissues. FIG. 22A depicts transcription profiling data in various soybean tissues of the soybean endogenous miR319 decoy SEQ ID NO. 8847 (MRT3847_41831C.6, represented by probe A1GM001017_at); FIG. 22B depicts transcription profiling data in various maize tissues of the maize endogenous miR319 decoy SEQ ID NO. 8849 (MRT4577_577703C.1, represented by probe A1ZM012886_s_at), as described in Example 11.

DETAILED DESCRIPTION OF THE INVENTION

Figure 1:
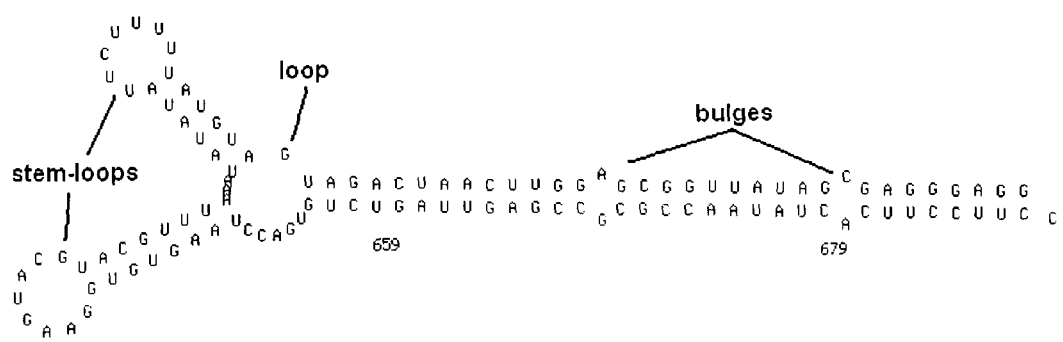
FIG. 1 depicts a non-limiting example of a fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, more specifically, the fold-back structure of the miRNA precursor sequence having SEQ ID NO. 1136, which includes two short stem-loops, a loop, and two bulges. The miRNA precursor is processed in planta to a mature miRNA (in this particular example, to the mature miRNA having SEQ ID NO. 32).

Unless defined otherwise, all technical and scientific terms used have the same meaning as commonly understood by one of ordinary skill in the art to which this invention belongs. Generally, the nomenclature used and the manufacture or laboratory procedures described below are well known and commonly employed in the art. Conventional methods are used for these procedures, such as those provided in the art and various general references. Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as is known to one of ordinary skill in the art. Where a term is provided in the singular, the inventors also contemplate aspects of the invention described by the plural of that term. The nomenclature used and the laboratory procedures described below are those well known and commonly employed in the art. Where there are discrepancies in terms and definitions used in references that are incorporated by reference, the terms used in this application shall have the definitions given. Other technical terms used have their ordinary meaning in the art that they are used, as exemplified by a variety of technical dictionaries. The inventors do not intend to be limited to a mechanism or mode of action. Reference thereto is provided for illustrative purposes only.

Recombinant DNA Constructs

This invention provides a recombinant DNA construct including at least one transcribable DNA element for modulating the expression of at least one target gene, wherein the at least one transcribable DNA element is selected from the group consisting of: (a) a DNA element that transcribes to an miRNA precursor with the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, wherein the miRNA precursor includes a contiguous segment of at least 90% of the nucleotides of the maize, rice, or soybean miRNA precursor sequence; (b) a DNA element that transcribes to an engineered miRNA precursor derived from the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819, wherein the engineered miRNA precursor includes a modified mature miRNA; (c) a DNA element that is located within or adjacent to a transgene transcription unit and that is transcribed to RNA including a miRNA recognition site recognized by a mature miRNA selected from a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or by a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819; and (d) a DNA element for suppressing expression of an endogenous miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819. Target genes, the expression of which can be modulated by use of a recombinant DNA construct of this invention, are described under the heading "Target Genes". Embodiments and utilities of the at least one transcribable DNA element are described below.

(A) Expression of a Native miRNA Under Non-Native Conditions.

In one embodiment of the recombinant DNA construct, the at least one transcribable DNA element for modulating the expression of at least one target gene includes a DNA element that transcribes to an miRNA precursor with the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819, wherein the miRNA precursor includes a contiguous segment of at least 90% of the nucleotides of the maize, rice, or soybean miRNA precursor sequence. In preferred embodiments, the at least one target gene is an endogenous gene of a plant, and expression of the recombinant DNA construct in the plant results in suppression of the at least one target gene. By "miRNA precursor" is meant a transcribed RNA that is larger than a mature miRNA processed from the miRNA precursor, and that typically can be predicted to form a fold-back structure containing non-perfectly complementary double-stranded RNA regions. See Bartel (2004) *Cell*, 116: 281-297; Kim (2005) *Nature Rev. Mol. Cell. Biol.*, 6:376-385; Jones-Rhoades et al. (2006) *Annu. Rev. Plant Biol.*, 57:19-53; Ambros et al. (2003) *RNA*, 9:277-279. Examples of microRNA precursors include, but are not limited to, the primary miRNA transcript (pri-miRNA) as well as the pre-miRNA that is natively derived from a pri-miRNA; miRNA precursors also include non-natural RNA sequences that are predicted to form a fold-back structure containing non-perfectly complementary double-stranded RNA regions and are processed in vivo, generally by one or more cleavage steps, to a mature miRNA. By "miRNA precursor sequence" is meant an RNA sequence that includes at least the nucleotides of the miRNA precursor but that may include additional nucleotides (such that the miRNA precursor includes a contiguous segment of at least 90% of the nucleotides of the maize, rice, or soybean miRNA precursor sequence). Each miRNA precursor itself forms a fold-back structure that is identical or near-identical to the fold-back structure that is formed by at least part of the corresponding miRNA precursor sequence.

In these embodiments, the miRNA precursor need not include all of the nucleotides contained in a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819, but preferably includes a contiguous segment of at least 80%, or at least 85%, or at least 90%, or at least 95%, or at least 97%, or at least 98%, or at least 99% of the nucleotides of a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819.

In preferred embodiments, the at least one target gene is an endogenous gene of a plant, and thus expression of the recombinant DNA construct in the plant results in suppression of the at least one target gene. Transcription of the recombinant DNA construct in a transgenic plant cell modulates the expression of any gene (endogenous genes or transgenes) that contains a sequence ("miRNA recognition site") that is substantially complementary to and recognized by the mature miRNA encoded by the miRNA precursor. Generally, transcription of the recombinant DNA construct results in suppression of an endogenous gene that contains a miRNA recognition site that is recognized by the mature miRNA encoded by the miRNA precursor. In preferred embodiments, the recombinant DNA construct further includes a promoter other than the native promoter of the miRNA sequence. This permits expression of the mature miRNA under spatial or temporal or inducible conditions under which it would not natively be expressed. For example, the recombinant DNA construct can be designed to include a constitutive promoter and thus constitutively express a mature miRNA that is natively expressed (i.e., when expressed in the form of the endogenous miRNA precursor under the control of the native promoter) only under dark conditions. Promoters that are useful with this recombinant DNA construct are described under the heading "Promoters".

In one non-limiting example, the recombinant DNA construct includes a transcribable DNA element for modulating the expression of at least one target gene, wherein the at least one transcribable DNA element includes a DNA element that transcribes to an miRNA precursor that is a contiguous segment consisting of about 90% of the nucleotides of the maize miRNA precursor sequence having SEQ ID NO. 1136, and that is predicted to have a fold-back structure that is substantially the same (that is, having areas of double-stranded RNA stems and single-stranded loops or bulges in the same or approximately the same location) as the fold-back structure of the miRNA precursor sequence having SEQ ID NO. 1136. The fold-back structure of the miRNA precursor sequence having SEQ ID NO. 1136 includes about 118 nucleotides, with two short stem-loops projecting from a loop at the closed end of the fold-back structure, and two small bulges within the main double-stranded "stem" of the fold-back structure (FIG. 1). The mature miRNA processed in planta from a miRNA precursor that is a contiguous segment consisting of about 90% of the nucleotides of the maize miRNA precursor sequence having SEQ ID NO. 1136 is preferably identical to that encoded by the fold-back structure of the miRNA precursor sequence having SEQ ID NO. 1136, i.e., the mature miRNA having SEQ ID NO. 32. Transcription of this recombinant DNA construct preferably results in suppression of at least one endogenous gene that contains a miRNA recognition site that is recognized by the mature miRNA having SEQ ID NO. 32. While the maize miRNA precursor sequence having SEQ ID NO. 1136 is natively expressed in kernel tissue but not in leaf (see Table 2), the recombinant DNA construct can further include a promoter other than the native promoter of the miRNA s precursor sequence having SEQ ID NO. 1136, e.g., a constitutive promoter, to allow transcription of a mature miRNA having SEQ ID NO. 32 in tissues in addition to kernel tissue.

(B) Expression of an Engineered Mature miRNA.

In another embodiment of the recombinant DNA construct, the at least one transcribable DNA element for modulating the expression of at least one target gene includes a DNA element that transcribes to an engineered miRNA precursor derived from the fold-back structure of a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, wherein the engineered miRNA precursor includes a modified mature miRNA. In preferred embodiments, the at least one target gene is an endogenous gene of a plant or an endogenous gene of a pest or pathogen of the plant, and expression of the recombinant DNA construct in the plant results in suppression of the at least one target gene. By "engineered" is meant that nucleotides are changed (substituted, deleted, or added) in a native miRNA precursor sequence such a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, thereby resulting in an engineered miRNA precursor having substantially the same the fold-back structure as the native miRNA precursor sequence, but wherein the mature miRNA that is processed from the engineered miRNA precursor has a modified sequence (i.e., different from that of the native mature miRNA) that is designed to suppress a target gene different from the target genes natively suppressed by the native miRNA precursor sequence.

One general, non-limiting method for determining nucleotide changes in the native miRNA precursor sequence to produce the engineered miRNA precursor, useful in making a recombinant DNA construct of this invention, includes the steps:

(a) Selecting a unique target sequence of at least 18 nucleotides specific to the target gene, e.g. by using sequence alignment tools such as BLAST (see, for example, Altschul et al. (1990) *J. Mol. Biol.*, 215:403-410; Altschul et al. (1997) *Nucleic Acids Res.*, 25:3389-3402), for example, of both maize cDNA and genomic DNA databases, to identify target transcript orthologues and any potential matches to unrelated genes, thereby avoiding unintentional silencing of non-target sequences.

(b) Analyzing the target gene for undesirable sequences (e.g., matches to sequences from non-target species, especially animals), and score each potential 19-mer segment for GC content, Reynolds score (see Reynolds et al. (2004) *Nature Biotechnol.*, 22:326-330), and functional asymmetry characterized by a negative difference in free energy ("ΔΔG") (see Khvorova et al. (2003) *Cell*, 115:209-216). Preferably 19-mers are selected that have all or most of the following characteristics: (1) a Reynolds score>4, (2) a GC content between about 40% to about 60%, (3) a negative ΔΔG, (4) a terminal adenosine, (5) lack of a consecutive run of 4 or more of the same nucleotide; (6) a location near the 3' terminus of the target gene; (7) minimal differences from the miRNA precursor transcript. Preferably multiple (3 or more) 19-mers are selected for testing.

(c) Determining the reverse complement of the selected 19-mers to use in making a modified mature miRNA; the additional nucleotide at position 20 is preferably matched to the selected target sequence, and the nucleotide at position 21 is preferably chosen to be unpaired to prevent spreading of silencing on the target transcript.

(d) Testing the engineered miRNA precursor, for example, in an *Agrobacterium* mediated transient *Nicotiana benthamiana* assay for modified mature miRNA expression and target repression.

and (e) Cloning the most effective engineered miRNA precursor into a construct for stable transformation of maize (see the sections under the headings "Making and Using Recombinant DNA Constructs" and "Making and Using Non-natural Transgenic plant Cells and Non-natural Transgenic Plants").

(C) Expression of a Transgene and a miRNA Recognition Site.

In another embodiment of the recombinant DNA construct, the recombinant DNA construct further includes a transgene transcription unit, wherein the at least one transcribable DNA element for modulating the expression of at least one target gene includes a DNA element that is located within or adjacent to the transgene transcription unit and that is transcribed to RNA including a miRNA recognition site recognized by a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819, and the at least one target gene includes the transgene encoded by the transgene transcription unit, and wherein expression of the recombinant DNA construct in a plant results in expression of the transgene in cells of the plant wherein the mature miRNA is not natively expressed. Preferred embodiments of miRNA recognition sites are those predicted to be recognized by at least one mature miRNA selected from a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or by at least one mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819. Prediction of a recognition site is achieved using methods known in the art, such as sequence complementarity rules as described by Zhang (2005) *Nucleic Acids Res.*, 33:W701-704 and by Rhoades et al. (2002) *Cell*, 110:513-520.

Prediction of a miRNA recognition site permits identification and validation of endogenous genes regulated by miRNAs from a natively expressed miRNA precursor; this is useful, e.g., to eliminate or modify a miRNA recognition site in an endogenous gene in order to decouple expression of that gene from regulation by the endogenous miRNA that natively regulates expression of the gene. For example, the number of mispairs involving bases at positions 2 to 13 (in a miRNA recognition site having contiguous 21 nucleotides) can be increased to prevent recognition and cleavage by the miRNA.

These recombinant DNA constructs are particularly useful for in planta expression of the transgene under a specific spatial, temporal, or inducible pattern without the need of a promoter having that specific expression pattern. These recombinant DNA constructs allow, for example, the restricted expression of a gene transcribed by a constitutive promoter or a promoter with expression beyond the desired cell or tissue type(s). Restricted expression may be spatially or temporally restricted, e.g., restricted to specific tissues or cell types or files, or to specific developmental, reproductive, growth, or seasonal stages. Where a miRNA is expressed under particular conditions (e.g., under biotic stress such as crowding, allelopathic interactions or pest or pathogen infestation, or abiotic stress such as heat or cold stress, drought stress, nutrient stress, heavy metal or salt stress), the corresponding miRNA recognition site can be used for conditionally specific suppression, i.e., to suppress a transgene under the particular condition. In a non-limiting example, a recombinant DNA construct of this invention that encodes (a) a transgene under the control of a constitutive promoter and (b) a miRNA recognition site recognized by a mature miRNA that is specifically expressed only under conditions of water stress, can be used for expression of the transgene in a plant under non-water-stress conditions. In another non-limiting example, a recombinant DNA construct of this invention that encodes (a) a transgene expressing an insecticidal protein under the control of a promoter specifically inducible by wounding, and (b) a miRNA recognition site recognized by a mature miRNA that is expressed in tissues other than root, can be used for limited expression of the insecticidal protein in plant roots under conditions when the plant is wounded by an insect pest.

The transgene transcription unit includes at least a transgene, and optionally additional sequence such as, but not limited to, a promoter, a promoter enhancer, a terminator, messenger RNA stabilizing or destabilizing sequence (see, e.g., Newman et al. (1993) *Plant Cell*, 5:701-714; Green (1993) *Plant Physiol.*, 102:1065-1070; and Ohme-Takagi et al. (1993) *Proc. Natl. Acad. Sci. USA*, 90:11811-11815), sequence for localization or transport of the transgene transcript to a specific locale (e.g., mitochondrion, plastid, nucleolus, peroxisome, endoplasmic reticulum, etc.), or other sequence related to the desired processing of the transgene. The transgene encoded by the transgene transcription unit can include any one or more genes of interest, including coding sequence, non-coding sequence, or both. Genes of interest can include any of the genes listed under "Target Genes", preferred examples of which include translatable (coding) sequence for genes encoding transcription factors and genes encoding enzymes involved in the biosynthesis or catabolism of molecules of interest (such as, but not limited to, amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin).

(D) Suppression of an Endogenous or Native miRNA.

In yet another embodiment of the recombinant DNA construct, the at least one transcribable DNA element for modulating the expression of at least one target gene includes a DNA element for suppressing expression of an endogenous miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741. SEQ ID NO. 8743, SEQ ID NO. 8800, and SEQ ID NOS. 8816-8819. In preferred embodiments, the at least one target gene is an endogenous gene of a plant, and expression of the endogenous gene is suppressed in cells of the plant where native expression of the endogenous miRNA occurs, and thus expression of the recombinant DNA construct in the cells results in expression of the endogenous gene in the cells.

The DNA element for suppressing expression includes at least one of:

(a) DNA that includes at least one anti-sense DNA segment that is anti-sense to at least one segment of the target gene;

(b) DNA that includes multiple copies of at least one anti-sense DNA segment that is anti-sense to at least one segment of the target gene;

(c) DNA that includes at least one sense DNA segment that is at least one segment of the target gene;

(d) DNA that includes multiple copies of at least one sense DNA segment that is at least one segment of the target gene;

(e) DNA that transcribes to RNA for suppressing the target gene by forming double-stranded RNA and includes at least one anti-sense DNA segment that is anti-sense to at least one segment of the target gene and at least one sense DNA segment that is at least one segment of the target gene;

(f) DNA that transcribes to RNA for suppressing the target gene by forming a single double-stranded RNA and includes multiple serial anti-sense DNA segments that are anti-sense to at least one segment of the target gene and multiple serial sense DNA segments that are at least one segment of the target gene;

(g) DNA that transcribes to RNA for suppressing the target gene by forming multiple double strands of RNA and includes multiple anti-sense DNA segments that are anti-sense to at least one segment of the target gene and multiple sense DNA segments that are at least one segment of the target gene, and wherein the multiple anti-sense DNA segments and the multiple sense DNA segments are arranged in a series of inverted repeats;

(h) DNA that includes nucleotides derived from a plant miRNA;

(i) DNA that includes nucleotides of a siRNA;

(j) DNA that transcribes to an RNA aptamer capable of binding to a ligand; and (k) DNA that transcribes to an RNA aptamer capable of binding to a ligand, and DNA that transcribes to regulatory RNA capable of regulating expression of the target gene, wherein the regulation is dependent on the conformation of the regulatory RNA, and the conformation of the regulatory RNA is allosterically affected by the binding state of the RNA aptamer.

Figure 3:
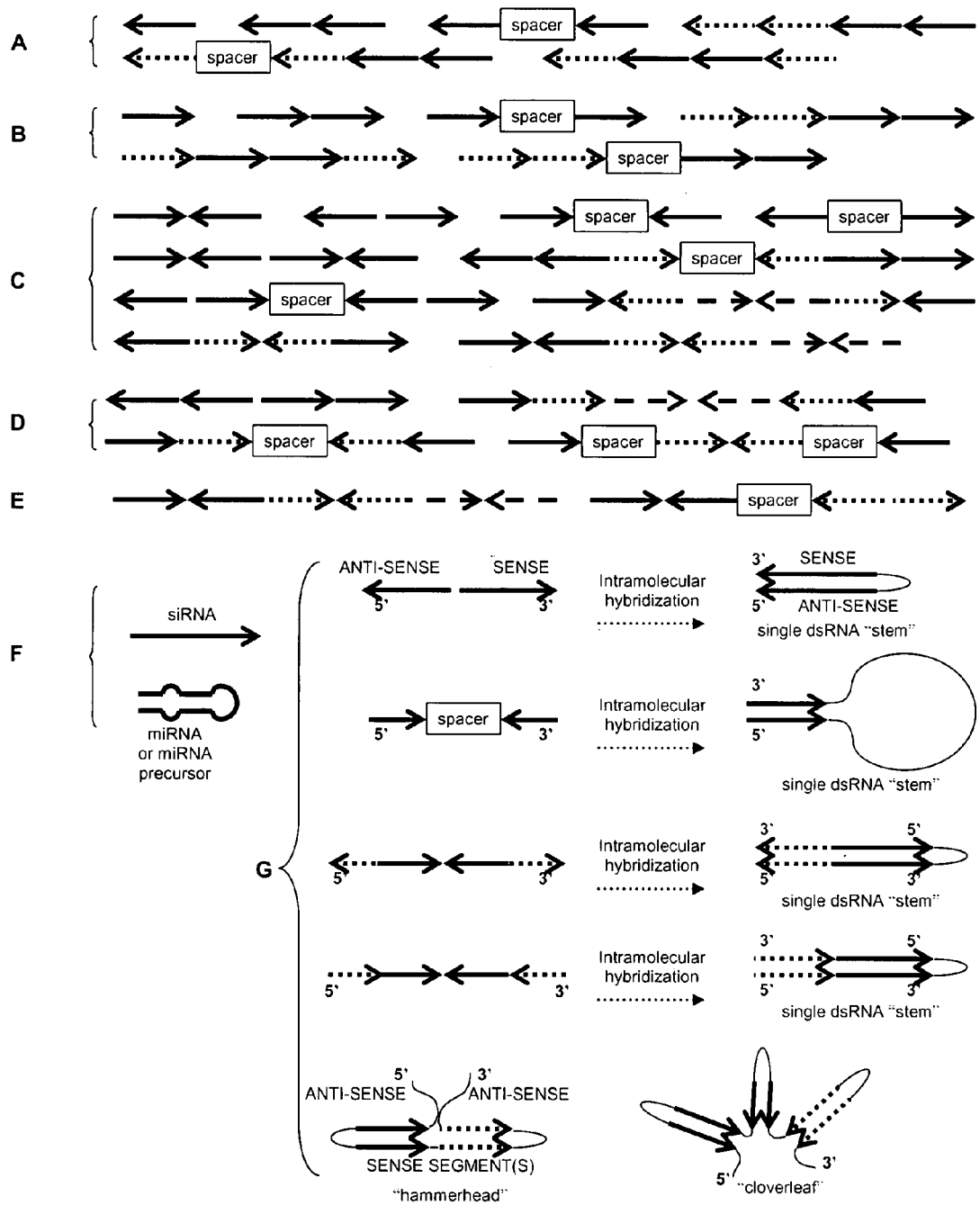

DNA elements for suppressing expression are described further in Example 3 and depicted in FIGS. 2 and 3.

In some embodiments, the recombinant DNA construct includes DNA designed to be transcribed to single-stranded RNA or to at least partially double-stranded RNA (such as in a "kissing stem-loop" arrangement), or to an RNA that assumes a secondary structure or three-dimensional configuration (e.g., a large loop of antisense sequence of the target gene or an aptamer) that confers on the transcript an additional desired characteristic, such as increased stability, increased half-life in vivo, or cell or tissue specificity. In one example, the spacer is transcribed to a stabilizing loop that links the first and second series of contiguous RNA segments (see, for example, Di Giusto and King (2004) *J. Biol. Chem.*, 279:46483-46489). In another example, the recombinant DNA construct includes DNA that transcribes to RNA including an RNA aptamer (e.g., an aptamer that binds to a cell-specific ligand) that allows cell- or tissue-specific targetting of the recombinant RNA duplex.

The recombinant DNA construct is made by commonly used techniques, such as those described under the heading "Making and Using Recombinant DNA Constructs" and illustrated in the working Examples. The recombinant DNA construct is particularly useful for making non-natural transgenic plant cells, non-natural transgenic plants, and transgenic seeds as discussed below under "Transgenic Plant Cells and Transgenic Plants".

The effects of a miRNA on its target gene can be controlled by alternative methods described in detail below under "MicroRNA Decoy Sequences".

Target Genes

The recombinant DNA construct of this invention can be designed to suppress any target gene or genes. The target gene can be translatable (coding) sequence, or can be non-coding sequence (such as non-coding regulatory sequence), or both, and can include at least one gene selected from the group consisting of a eukaryotic target gene, a non-eukaryotic target gene, a microRNA precursor DNA sequence, and a microRNA promoter. The target gene can be native (endogenous) to the cell (e.g., a cell of a plant or animal) in which the recombinant DNA construct is transcribed, or can be native to a pest or pathogen of the plant or animal in which the recombinant DNA construct is transcribed. The target gene can be an exogenous gene, such as a transgene in a plant. A target gene can be a native gene targetted for suppression, with or without concurrent expression of an exogenous transgene, for example, by including a gene expression element in the recombinant DNA construct, or in a separate recombinant DNA construct. For example, it can be desirable to replace a native gene with an exogenous transgene homologue.

The target gene can include a single gene or part of a single gene that is targetted for suppression, or can include, for example, multiple consecutive segments of a target gene, multiple non-consecutive segments of a target gene, multiple alleles of a target gene, or multiple target genes from one or more species. A target gene can include any sequence from any species (including, but not limited to, non-eukaryotes such as bacteria, and viruses; fungi; plants, including monocots and dicots, such as crop plants, ornamental plants, and non-domesticated or wild plants; invertebrates such as arthropods, annelids, nematodes, and molluscs; and vertebrates such as amphibians, fish, birds, domestic or wild mammals, and even humans.

In one embodiment, the target gene is exogenous to the plant in which the recombinant DNA construct is to be transcribed, but endogenous to a pest or pathogen (e.g., viruses, bacteria, fungi, oomycetes, and invertebrates such as insects, nematodes, and molluscs) of the plant. The target gene can include multiple target genes, or multiple segments of one or more genes. In one preferred embodiment, the target gene or genes is a gene or genes of an invertebrate pest or pathogen of the plant. These embodiments are particularly useful in providing non-natural transgenic plants having resistance to one or more plant pests or pathogens, for example, resistance to a nematode such as soybean cyst nematode or root knot nematode or to a pest insect.

The target gene can be translatable (coding) sequence, or can be non-coding sequence (such as non-coding regulatory sequence), or both. Non-limiting examples of a target gene include non-translatable (non-coding) sequence, such as, but not limited to, 5' untranslated regions, promoters, enhancers, or other non-coding transcriptional regions, 3' untranslated regions, terminators, and introns. Target genes include genes encoding microRNAs, small interfering RNAs, RNA components of ribosomes or ribozymes, small nucleolar RNAs, and other non-coding RNAs (see, for example, non-coding RNA sequences provided publicly at rfam.wustl.edu; Erdmann et al. (2001) *Nucleic Acids Res.*, 29:189-193; Gottesman (2005) *Trends Genet.*, 21:399-404; Griffiths-Jones et al. (2005) *Nucleic Acids Res.*, 33:121-124). One specific example of a target gene includes a microRNA recognition site (that is, the site on an RNA strand to which a mature miRNA binds and induces cleavage). Another specific example of a target gene includes a microRNA precursor sequence native to a pest or pathogen of the non-natural transgenic plant, that is, the primary transcript encoding a microRNA, or the RNA intermediates processed from this primary transcript (e.g., a nuclear-limited pri-miRNA or a pre-miRNA which can be exported from the nucleus into the cytoplasm). See, for example, Lee et al. (2002) *EMBO Journal*, 21:4663-4670; Reinhart et al. (2002) *Genes & Dev.*, 16:161611626; Lund et al. (2004) *Science*, 303:95-98; and Millar and Waterhouse (2005) *Funct. Integr. Genomics*, 5:129-135. Target genes can also include translatable (coding) sequence for genes encoding transcription factors and genes encoding enzymes involved in the biosynthesis or catabolism of molecules of interest (such as, but not limited to, amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin).

In many preferred embodiments, the target gene is an essential gene of a plant pest or pathogen. Essential genes include genes that are required for development of the pest or pathogen to a fertile reproductive adult. Essential genes include genes that, when silenced or suppressed, result in the death of the organism (as an adult or at any developmental stage, including gametes) or in the organism's inability to successfully reproduce (e.g., sterility in a male or female parent or lethality to the zygote, embryo, or larva). A description of nematode essential genes is found, e.g., in Kemphues, K. "Essential Genes" (Dec. 24, 2005), WormBook, ed. The *C. elegans* Research Community, WormBook, doi/10.1895/wormbook.1.57.1, available on line at www.wormbook.org. Non-limiting examples of nematode essential genes include major sperm protein, RNA polymerase II, and chitin synthase (see, e.g., U.S. Patent Application Publication US20040098761 A1); additional soybean cyst nematode essential genes are provided in U.S. patent application Ser. No. 11/360,355, filed 23 Feb. 2006, incorporated by reference herein. A description of insect genes is publicly available at the *Drosophila* genome database (available on line at flybase.bio.indiana.edu/). The majority of predicted *Drosophila* genes have been analyzed for function by a cell culture-based RNA interference screen, resulting in 438 essential genes being identified; see Boutros et al. (2004) *Science*, 303:832-835, and supporting material available on line at www.sciencemag.org/cgi/content/full/303/5659/832/DC1. A description of bacterial and fungal essential genes is provided in the Database of Essential Genes ("DEG", available on line at tubic.tju.edu.cn/deg/); see Zhang et al. (2004) *Nucleic Acids Res.*, 32:D271-D272.

Plant pest invertebrates include, but are not limited to, pest nematodes, pest molluscs (slugs and snails), and pest insects. Plant pathogens of interest include fungi, oomycetes, bacteria (e.g., the bacteria that cause leaf spotting, fireblight, crown gall, and bacterial wilt), mollicutes, and viruses (e.g., the viruses that cause mosaics, vein banding, flecking, spotting, or abnormal growth). See also G. N. Agrios, "Plant Pathology" (Fourth Edition), Academic Press, San Diego, 1997, 635 pp., for descriptions of fungi, bacteria, mollicutes (including mycoplasmas and *spiroplasmas*), viruses, nematodes, parasitic higher plants, and flagellate protozoans, all of which are plant pests or pathogens of interest. See also the continually updated compilation of plant pests and pathogens and the diseases caused by such on the American Phytopathological Society's "Common Names of Plant Diseases", compiled by the Committee on Standardization of Common Names for Plant Diseases of The American Phytopathological Society, 1978-2005, available online at www.apsnet.org/online/common/top.asp.

Non-limiting examples of fungal plant pathogens of particular interest include, e.g., the fungi that cause powdery mildew, rust, leaf spot and blight, damping-off, root rot, crown rot, cotton boll rot, stem canker, twig canker, vascular wilt, smut, or mold, including, but not limited to, *Fusarium* spp., *Phakospora* spp., *Rhizoctonia* spp., *Aspergillus* spp., *Gibberella* spp., *Pyricularia* spp., and *Alternaria* spp. Specific examples of fungal plant pathogens include *Phakospora pachirhizi* (Asian soybean rust), *Puccinia sorghi* (corn common rust), *Puccinia polysora* (corn Southern rust), *Fusarium oxysporum* and other *Fusarium* spp., *Alternaria* spp., *Penicillium* spp., *Rhizoctonia solani, Exserohilum turcicum* (Northern corn leaf blight), *Bipolaris maydis* (Southern corn leaf blight), *Ustilago maydis* (corn smut), *Fusarium graminearum* (*Gibberella zeae*), *Fusarium verticilliodes* (*Gibberella moniliformis*), *F. proliferatum* (*G. fujikuroi* var. *intermedia*), *F. subglutinans* (*G. subglutinans*), *Diplodia maydis, Sporisorium holci-sorghi, Colletotrichum graminicola, Setosphaeria turcica, Aureobasidium zeae, Sclerotinia sclerotiorum*, and the numerous fungal species provided in Tables 4 and 5 of U.S. Pat. No. 6,194,636, which is incorporated in its entirety by reference herein. Non-limiting examples of plant pathogens include pathogens previously classified as fungi but more recently classified as oomycetes. Specific examples of oomycete plant pathogens of particular interest include members of the genus *Pythium* (e.g., *Pythium aphanidermatum*) and *Phytophthora* (e.g., *Phytophthora infestans, Phytophthora sojae*,) and organisms that cause downy mildew (e.g., *Peronospora farinosa*).

Non-limiting examples of bacterial pathogens include the mycoplasmas that cause yellows disease and *spiroplasmas* such as *Spiroplasma kunkelii*, which causes corn stunt, eubacteria such as *Pseudomonas avenae, Pseudomonas andropogonis, Erwinia stewartii, Pseudomonas syringae* pv. *syringae, Xylella fastidiosa*, and the numerous bacterial species listed in Table 3 of U.S. Pat. No. 6,194,636, which is incorporated in its entirety by reference herein.

Non-limiting examples of viral plant pathogens of particular interest include maize dwarf mosaic virus (MDMV), sugarcane mosaic virus (SCMV, formerly MDMV strain B), wheat streak mosaic virus (WSMV), maize chlorotic dwarf virus (MCDV), barley yellow dwarf virus (BYDV), banana bunchy top virus (BBTV), and the numerous viruses listed in Table 2 of U.S. Pat. No. 6,194,636, which is incorporated in its entirety by reference herein.

Non-limiting examples of invertebrate pests include cyst nematodes *Heterodera* spp. especially soybean cyst nematode *Heterodera glycines*, root knot nematodes *Meloidogyne* spp., lance nematodes *Hoplolaimus* spp., stunt nematodes *Tylenchorhynchus* spp., spiral nematodes *Helicotylenchus* spp., lesion nematodes *Pratylenchus* spp., ring nematodes *Criconema* spp., foliar nematodes *Aphelenchus* spp. or *Aphelenchoides* spp., corn rootworms, *Lygus* spp., aphids and similar sap-sucking insects such as phylloxera (*Daktulosphaira vitifoliae*), corn borers, cutworms, armyworms, leafhoppers, Japanese beetles, grasshoppers, and other pest coleopterans, dipterans, and lepidopterans. Specific examples of invertebrate pests include pests capable of infesting the root systems of crop plants, e.g., northern corn rootworm (*Diabrotica barberi*), southern corn rootworm (*Diabrotica undecimpunctata*), Western corn rootworm (*Diabrotica virgifera*), corn root aphid (*Anuraphis maidiradicis*), black cutworm (*Agrotis ipsilon*), glassy cutworm (*Crymodes devastator*), dingy cutworm (*Feltia ducens*), claybacked cutworm (*Agrotis gladiaria*), wireworm (*Melanotus* spp., *Aeolus mellillus*), wheat wireworm (*Aeolus mancus*), sand wireworm (*Horistonotus uhlerii*), maize billbug (*Sphenophorus maidis*), timothy billbug (*Sphenophorus zeae*), bluegrass billbug (*Sphenophorus parvulus*), southern corn billbug (*Sphenophorus callosus*), white grubs (*Phyllophaga* spp.), seedcorn maggot (*Delia platura*), grape colaspis (*Colaspis brunnea*), seedcorn beetle (*Stenolophus lecontei*), and slender seedcorn beetle (*Clivinia impressifrons*), as well as the parasitic nematodes listed in Table 6 of U.S. Pat. No. 6,194,636, which is incorporated in its entirety by reference herein.

Invertebrate pests of particular interest, especially in but not limited to southern hemisphere regions (including South and Central America) include aphids, corn rootworms, spodoptera, noctuideae, potato beetle, *Lygus* spp., any hemipteran, homopteran, or heteropteran, any lepidopteran, any coleopteran, nematodes, cutworms, earworms, armyworms, borers, leaf rollers, and others. Arthropod pests specifically encompassed by this invention include various cutworm species including cutworm (*Agrotis repleta*), black cutworm (*Agrotis ipsilon*), cutworm (*Anicla ignicans*), granulate cutworm (*Feltia subterranea*), "gusano aspero" (*Agrotis malefida*); Mediterranean flour moth (*Anagasta kuehniella*), square-necked grain beetle (*Cathartus quadricollis*), flea beetle (*Chaetocnema* spp), rice moth (*Corcyra cephalonica*), corn rootworm or "vaquita de San Antonio" (*Diabotica speciosa*), sugarcane borer (*Diatraea saccharalis*), lesser cornstalk borer (*Elasmopalpus lignosellus*), brown stink bug (*Euschistus* spp.), corn earworm (*Helicoverpa zea*), flat grain beetle (*Laemophloeus minutus*), grass looper moth (*Mocis latipes*), sawtoothed grain beetle (*Oryzaephilus surinamensis*), meal moth (*Pyralis farinalis*), Indian meal moth (*Plodia interpunctella*), corn leaf aphid (*Rhopalosiphum maidis*), brown burrowing bug or "chinche subterranea" (*Scaptocoris castanea*), greenbug (*Schizaphis graminum*), grain weevil (*Sitophilus zeamais*), Angoumois grain moth (*Sitotroga cerealella*), fall armyworm (*Spodoptera frugiperda*), cadelle beetle (*Tenebroides mauritanicus*), two-spotted spider mite (*Tetranychus urticae*), red flour beetle (*Triboleum castaneum*), cotton leafworm (*Alabama argillacea*), boll weevil (*Anthonomus grandis*), cotton aphid (*Aphis gossypii*), sweet potato whitefly (*Bemisia tabaci*), various thrips species (*Frankliniella* spp.), cotton earworm (*Helicoverpa zea*), "oruga bolillera" (e.g., *Helicoverpa geletopoeon*), tobacco budworm (*Heliothis virescens*), stinkbug (*Nezara viridula*), pink bollworm (*Pectinophora gossypiella*), beet armyworm (*Spodoptera exigua*), spider mites (*Tetranychus* spp.), onion thrips (*Thrips tabaci*), greenhouse whitefly (*Trialeurodes vaporarium*), velvetbean caterpillar (*Anticarsia gemmatalis*), spotted maize beetle or "astilo moteado" (*Astylus atromaculatus*), "oruga de la alfalfa" (*Colias lesbia*), "chinche marrón" or "chinche de los cuernos" (*Dichelops furcatus*), "al quiche chico" (*Edessa miditabunda*), blister beetles (*Epicauta* spp.), "barrenador del brote" (*Epinotia aporema*), "oruga verde del yuyo colorado" (*Loxostege bifidalis*), rootknot nematodes (*Meloidogyne* spp.), "oruga cuarteadora" (*Mocis repanda*), southern green stink bug (*Nezara viridula*), "chinche de la alfalfa" (*Piezodorus guildinii*), green cloverworm (*Plathypena scabra*), soybean looper (*Pseudoplisia includens*), looper moth "isoca medidora del girasol" (*Rachiplusia nu*), yellow woolybear (*Spilosoma virginica*), yellowstriped armyworm (*Spodoptera ornithogalli*), various root weevils (family Curculionidae), various wireworms (family Elateridae), and various white grubs (family Scarabaeidae). Nematode pests specifically encompassed by this invention include nematode pests of maize (*Belonolaimus* spp., *Trichodorus* spp., *Longidorus* spp., *Dolichodorus* spp., *Anguina* spp., *Pratylenchus* spp., *Meloidogyne* spp., *Heterodera* spp.), soybean (*Heterodera glycines Meloidogyne* spp., *Belonolaimus* spp.), bananas (*Radopholus similis, Meloidogyne* spp., *Helicotylenchus* spp.), sugarcane (*Heterodera sacchari, Pratylenchus* spp., *Meloidogyne* spp.), oranges (*Tylenchulus* spp., *Radopholus* spp., *Belonolaimus* spp., *Pratylenchus* spp., *Xiphinema* spp.), coffee (*Meloidogyne* spp., *Pratylenchus* spp.), coconut palm (*Bursaphelenchus* spp.), tomatoes (*Meloidogyne* spp., *Belonolaimus* spp., *Nacobbus* spp.), grapes (*Meloidogyne* spp., *Xiphinema* spp., *Tylenchulus* spp., *Criconemella* spp.), lemon and lime (*Tylenchulus* spp., *Radopholus* spp., *Belonolaimus* spp., *Pratylenchus* spp., *Xiphinema* spp.), cacao (*Meloidogyne* spp., *Rotylenchulus reniformis*), pineapple (*Meloidogyne* spp., *Pratylenchus* spp., *Rotylenchulus reniformis*), papaya (*Meloidogyne* spp., *Rotylenchulus reniformis*), grapefruit (*Tylenchulus* spp., *Radopholus* spp. *Belonolaimus* spp., *Pratylenchus* spp., *Xiphinema* spp., and broad beans (*Meloidogyne* spp.).

Target genes from pests can include invertebrate genes for major sperm protein, alpha tubulin, beta tubulin, vacuolar ATPase, glyceraldehyde-3-phosphate dehydrogenase, RNA polymerase II, chitin synthase, cytochromes, miRNAs, miRNA precursor molecules, miRNA promoters, as well as other genes such as those disclosed in U.S. Patent Application Publication 2006/0021087 A1, PCT Patent Application PCT/US05/11816, and in Table II of U.S. Patent Application Publication 2004/0098761 A1, which are incorporated by reference herein. Target genes from pathogens can include genes for viral translation initiation factors, viral replicases, miRNAs, miRNA precursor molecules, fungal tubulin, fungal vacuolar ATPase, fungal chitin synthase, fungal MAP kinases, fungal Pac1 Tyr/Thr phosphatase, enzymes involved in nutrient transport (e.g., amino acid transporters or sugar transporters), enzymes involved in fungal cell wall biosynthesis, cutinases, melanin biosynthetic enzymes, polygalacturonases, pectinases, pectin lyases, cellulases, proteases, genes that interact with plant avirulence genes, and other genes involved in invasion and replication of the pathogen in the infected plant. Thus, a target gene need not be endogenous to the plant in which the recombinant DNA construct is transcribed. A recombinant DNA construct of this invention can be transcribed in a plant and used to suppress a gene of a pathogen or pest that may infest the plant.

Specific, non-limiting examples of suitable target genes also include amino acid catabolic genes (such as, but not limited to, the maize LKR/SDH gene encoding lysine-ketoglutarate reductase (LKR) and saccharopine dehydrogenase (SDH), and its homologues), maize zein genes, genes involved in fatty acid synthesis (e.g., plant microsomal fatty acid desaturases and plant acyl-ACP thioesterases, such as, but not limited to, those disclosed in U.S. Pat. Nos. 6,426,448, 6,372,965, and 6,872,872), genes involved in multi-step biosynthesis pathways, where it may be of interest to regulate the level of one or more intermediates, such as genes encoding enzymes for polyhydroxyalkanoate biosynthesis (see, for example, U.S. Pat. No. 5,750,848); and genes encoding cell-cycle control proteins, such as proteins with cyclin-dependent kinase (CDK) inhibitor-like activity (see, for example, genes disclosed in International Patent Application Publication Number WO 05007829A2). Target genes can include genes encoding undesirable proteins (e.g., allergens or toxins) or the enzymes for the biosynthesis of undesirable compounds (e.g., undesirable flavor or odor components). Thus, one embodiment of the invention is a non-natural transgenic plant or tissue of such a plant that is improved by the suppression of allergenic proteins or toxins, e.g., a peanut, soybean, or wheat kernel with decreased allergenicity. Target genes can include genes involved in fruit ripening, such as polygalacturonase. Target genes can include genes where expression is preferably limited to a particular cell or tissue or developmental stage, or where expression is preferably transient, that is to say, where constitutive or general suppression, or suppression that spreads through many tissues, is not necessarily desired. Thus, other examples of suitable target genes include genes encoding proteins that, when expressed in transgenic plants, make the transgenic plants resistant to pests or pathogens (see, for example, genes for cholesterol oxidase as disclosed in U.S. Pat. No. 5,763,245); genes where expression is pest- or pathogen-induced; and genes which can induce or restore fertility (see, for example, the barstar/barnase genes described in U.S. Pat. No. 6,759,575); all the patents cited in this paragraph are incorporated by reference in their entirety herein.

The recombinant DNA construct can be designed to be more specifically suppress the target gene, for example, by designing the recombinant DNA construct to encode a mature miRNA to include regions substantially non-identical (or non-complementary) to a non-target gene sequence. Non-target genes can include any gene not intended to be silenced or suppressed, either in a plant containing the recombinant DNA construct or in organisms that may come into contact with the recombinant DNA construct. A non-target gene sequence can include any sequence from any species (including, but not limited to, non-eukaryotes such as bacteria, and viruses; fungi; plants, including monocots and dicots, such as crop plants, ornamental plants, and non-domesticated or wild plants; invertebrates such as arthropods, annelids, nematodes, and molluscs; and vertebrates such as amphibians, fish, birds, domestic or wild mammals, and even humans).

In one embodiment, the target gene is a gene endogenous to a given species, such as a given plant (such as, but not limited to, agriculturally or commercially important plants, including monocots and dicots), and the non-target gene can be, e.g., a gene of a non-target species, such as another plant species or a gene of a virus, fungus, bacterium, invertebrate, or vertebrate, even a human. One non-limiting example is where the recombinant DNA construct is designed to suppress a target gene that is a gene endogenous to a single species (e.g., Western corn rootworm, *Diabrotica virgifera virgifera* LeConte) but to not suppress a non-target gene such as genes from related, even closely related, species (e.g., Northern corn rootworm, *Diabrotica barberi* Smith and Lawrence, or Southern corn rootworm, *Diabrotica undecimpunctata*).

In other embodiments (e.g., where it is desirable to suppress a target gene across multiple species), it may be desirable to design the recombinant DNA construct to suppress a target gene sequence common to the multiple species in which the target gene is to be silenced. Thus, an RNA duplex can be selected to be specific for one taxon (for example, specific to a genus, family, or even a larger taxon such as a phylum, e.g., arthropoda) but not for other taxa (e.g., plants or vertebrates or mammals). In one non-limiting example of this embodiment, a recombinant DNA construct for gene silencing can be selected so as to target pathogenic fungi (e.g., a *Fusarium* spp.) but not target any gene sequence from beneficial fungi.

In another non-limiting example of this embodiment, a recombinant DNA construct for gene silencing in corn rootworm can be selected to be specific to all members of the genus *Diabrotica*. In a further example of this embodiment, such a *Diabrotica*-targetted recombinant DNA construct can be selected so as to not target any gene sequence from beneficial coleopterans (for example, predatory coccinellid beetles, commonly known as ladybugs or ladybirds) or other beneficial insect species.

The required degree of specificity of a recombinant DNA construct of this invention for silencing a target gene depends on various factors. Factors can include the size and nucleic acid sequence of a mature microRNA encoded by the recombinant DNA construct, and the relative importance of decreasing such a mature miRNA's potential to suppress non-target genes. In a non-limiting example, where such a mature miRNA is expected to be 21 base pairs in size, one particularly preferred embodiment includes DNA encoding a mature miRNA for silencing a target gene wherein the mature miRNA includes sequence that is substantially non-identical to a non-target gene sequence, such as fewer than 18, or fewer than 17, or fewer than 16, or fewer than 15 matches out of 21 contiguous nucleotides of a non-target gene sequence.

In some embodiments, it may be desirable to design the recombinant DNA construct for silencing a target gene to include regions predicted to not generate undesirable polypeptides, for example, by screening the recombinant DNA construct for sequences that may encode known undesirable polypeptides or close homologues of these. Undesirable polypeptides include, but are not limited to, polypeptides homologous to known allergenic polypeptides and polypeptides homologous to known polypeptide toxins. Publicly available sequences encoding such undesirable potentially allergenic peptides are available, for example, the Food Allergy Research and Resource Program (FARRP) allergen database (available at allergenonline.com) or the Biotechnology Information for Food Safety Databases (available at www.iit.edu/~sgendel/fa.htm) (see also, for example, Gendel (1998) *Adv. Food Nutr. Res.,* 42:63-92). Undesirable sequences can also include, for example, those polypeptide sequences annotated as known toxins or as potential or known allergens and contained in publicly available databases such as GenBank, EMBL, SwissProt, and others, which are searchable by the Entrez system (www.ncbi.nih.gov/Entrez). Non-limiting examples of undesirable, potentially allergenic peptide sequences include glycinin from soybean, oleosin and agglutinin from peanut, glutenins from wheat, casein, lactalbumin, and lactoglobulin from bovine milk, and tropomyosin from various shellfish (allergenonline.com). Non-limiting examples of undesirable, potentially toxic peptides include tetanus toxin tetA from *Clostridium tetani*, diarrheal toxins from *Staphylococcus aureus*, and venoms such as conotoxins from *Conus* spp. and neurotoxins from arthropods and reptiles (www.ncbi.nih.gov/Entrez).

In one non-limiting example, the recombinant DNA construct is screened to eliminate those transcribable sequences encoding polypeptides with perfect homology to a known allergen or toxin over 8 contiguous amino acids, or with at least 35% identity over at least 80 amino acids; such screens can be performed on any and all possible reading frames in both directions, on potential open reading frames that begin with AUG (ATG in the corresponding DNA), or on all possible reading frames, regardless of whether they start with an AUG (or ATG) or not. When a "hit" or match is made, that is, when a sequence that encodes a potential polypeptide with perfect homology to a known allergen or toxin over 8 contiguous amino acids (or at least about 35% identity over at least about 80 amino acids), is identified, the nucleic acid sequences corresponding to the hit can be avoided, eliminated, or modified when selecting sequences to be used in an RNA for silencing a target gene. In one embodiment the recombinant DNA construct is designed so no potential open reading frame that begins with AUG (ATG in the corresponding DNA) is included.

Avoiding, elimination of, or modification of, an undesired sequence can be achieved by any of a number of methods known to those skilled in the art. In some cases, the result can be novel sequences that are believed to not exist naturally. For example, avoiding certain sequences can be accomplished by joining together "clean" sequences into novel chimeric sequences to be used in the RHA duplex.

Applicants recognize that in some microRNA-mediated gene silencing, it is possible for imperfectly matching miRNA sequences to be effective at gene silencing. For example, it has been shown that mismatches near the center of a miRNA complementary site has stronger effects on the miRNA's gene silencing than do more distally located mismatches. See, for example, FIG. 4 in Mallory et al. (2004) *EMBO J.,* 23:3356-3364. In another example, it has been reported that, both the position of a mismatched base pair and the identity of the nucleotides forming the mismatch influence the ability of a given siRNA to silence a target gene, and that adenine-cytosine mismatches, in addition to the G:U wobble base pair, were well tolerated (see Du et al. (2005) *Nucleic Acids Res.,* 33:1671-1677). Thus, a given strand of the recombinant DNA construct need not always have 100% sequence identity with the intended target gene, but generally would preferably have substantial sequence identity with the intended target gene, such as about 95%, about 90%, about 85%, or about 80% sequence identity with the intended target gene. Described in terms of complementarity, one strand of the recombinant DNA construct is preferably designed to have substantial complementarity to the intended target (e.g., a target messenger RNA or target non-coding RNA), such as about 95%, about 90%, about 85%, or about 80% complementarity to the intended target. In a non-limiting example, in the case of a recombinant DNA construct encoding a mature miRNA of 21 nucleotides, the encoded mature miRNA is designed to be is substantially but not perfectly complementary to 21 contiguous nucleotides of a target RNA; preferably the nucleotide at position 21 is unpaired with the corresponding position in the target RNA to prevent transitivity.

One skilled in the art would be capable of judging the importance given to screening for regions predicted to be more highly specific to the target gene or predicted to not generate undesirable polypeptides, relative to the importance given to other criteria, such as, but not limited to, the percent sequence identity with the intended target gene or the predicted gene silencing efficiency of a given sequence. For example, a recombinant DNA construct of this invention that encodes a mature miRNA may be designed to be active across several species, and therefore one skilled in the art can determine that it is more important to include in the recombinant DNA construct DNA encoding a mature miRNA that is specific to the several species of interest, but less important to screen for regions predicted to have higher gene silencing efficiency or for regions predicted to generate undesirable polypeptides.

Promoters

Generally, the recombinant DNA construct of this invention includes a promoter, functional in a plant cell, and operably linked to the transcribable DNA element. In various embodiments, the promoter is selected from the group consisting of a constitutive promoter, a spatially specific promoter, a temporally specific promoter, a developmentally specific promoter, and an inducible promoter.

Non-constitutive promoters suitable for use with the recombinant DNA constructs of the invention include spatially specific promoters, temporally specific promoters, and inducible promoters. Spatially specific promoters can include organelle-, cell-, tissue-, or organ-specific promoters (e.g., a plastid-specific, a root-specific, a pollen-specific, or a seed-specific promoter for suppressing expression of the first target RNA in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e.g., water deficit or drought, heat, cold, high or low nutrient or salt levels, high or low light levels, or pest or pathogen infection). An expression-specific promoter can also include promoters that are generally constitutively expressed but at differing degrees or "strengths" of expression, including promoters commonly regarded as "strong promoters" or as "weak promoters".

Promoters of particular interest include the following non-limiting examples: an opaline synthase promoter isolated from T-DNA of *Agrobacterium*; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of *Zea mays*); root specific promoters such as those disclosed in U.S. Pat. Nos. 5,837, 848; 6,437,217 and 6,426,446; a maize L3 oleosin promoter disclosed in U.S. Pat. No. 6,433,252; a promoter for a plant nuclear gene encoding a plastid-localized aldolase disclosed in U.S. Patent Application Publication 2004/0216189; cold-inducible promoters disclosed in U.S. Pat. No. 6,084,089; salt-inducible promoters disclosed in U.S. Pat. No. 6,140, 078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/ 0123347 A1. All of the above-described patents and patent publications disclosing promoters and their use, especially in recombinant DNA constructs functional in plants are incorporated herein by reference.

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer and a regulatory region (which can be cis-acting). See, for example, Isaacs et al. (2004) *Nat. Biotechnol.*, 22:841-847, Bayer and Smolke (2005) *Nature Biotechnol.*, 23:337-343, Mandal and Breaker (2004) *Nature Rev. Mol. Cell. Biol.*, 5:451-463, Davidson and Ellington (2005) *Trends Biotechnol.*, 23:109-112, Winkler et al. (2002) *Nature*, 419: 952-956, Sudarsan et al. (2003) *RNA*, 9:644-647, and Mandal and Breaker (2004) *Nature Struct. Mol. Biol.*, 11:29-35. Such "riboregulators" can be selected or designed for specific spatial or temporal specificity, for example, to regulate translation of the exogenous gene only in the presence (or absence) of a given concentration of the appropriate ligand.

Making and Using Recombinant DNA Constructs

The recombinant DNA constructs of this invention are made by any method suitable to the intended application, taking into account, for example, the type of expression desired and convenience of use in the plant in which the construct is to be transcribed. General methods for making and using DNA constructs and vectors are well known in the art and described in detail in, for example, handbooks and laboratory manuals including Sambrook and Russell, "Molecular Cloning: A Laboratory Manual" (third edition), Cold Spring Harbor Laboratory Press, NY, 2001. An example of useful technology for building DNA constructs and vectors for transformation is disclosed in U.S. Patent Application Publication 2004/0115642 A1, incorporated herein by reference. DNA constructs can also be built using the GATEWAY™ cloning technology (available from Invitrogen Life Technologies, Carlsbad, Calif.), which uses the site-specific recombinase LR cloning reaction of the Integrase/att system from bacteriophage lambda vector construction, instead of restriction endonucleases and ligases. The LR cloning reaction is disclosed in U.S. Pat. Nos. 5,888,732 and 6,277,608, and in U.S. Patent Application Publications 2001/283529, 2001/282319 and 2002/0007051, all of which are incorporated herein by reference. The GATEWAY™ Cloning Technology Instruction Manual, which is also supplied by Invitrogen, provides concise directions for routine cloning of any desired DNA into a vector comprising operable plant expression elements. Another alternative vector fabrication method employs ligation-independent cloning as disclosed by Aslandis et al. (1990) *Nucleic Acids Res.*, 18:6069-6074 and Rashtchian et al. (1992) *Biochem.*, 206:91-97, where a DNA fragment with single-stranded 5' and 3' ends is ligated into a desired vector which can then be amplified in vivo.

In certain embodiments, the DNA sequence of the recombinant DNA construct includes sequence that has been codon-optimized for the plant in which the recombinant DNA construct is to be expressed. For example, a recombinant DNA construct to be expressed in a plant can have all or parts of its sequence (e.g., the first gene suppression element or the gene expression element) codon-optimized for expression in a plant by methods known in the art. See, e.g., U.S. Pat. No. 5,500,365, incorporated by reference, for a description of codon-optimization for plants; see also De Amicis and Marchetti (2000) *Nucleic Acid Res.*, 28:3339-3346.

Transgenic Plant Cells and Plants

Another aspect of this invention provides a non-natural transgenic plant cell including any of the recombinant DNA constructs of this invention, as described above under the heading "Recombinant DNA Constructs". Further provided is a non-natural transgenic plant containing the non-natural transgenic plant cell of this invention. The non-natural transgenic plant of this invention includes plants of any developmental stage, and includes a regenerated plant prepared from the transgenic plant cells disclosed herein, or a progeny plant (which can be an inbred or hybrid progeny plant) of the regenerated plant, or seed of such a transgenic plant. Also provided and claimed is a transgenic seed having in its genome any of the recombinant DNA constructs provided by this invention. The non-natural transgenic plant cells, non-natural transgenic plants, and transgenic seeds of this invention are made by methods well-known in the art, as described below under the heading "Making and Using Non-natural Transgenic Plant Cells and Non-natural Transgenic Plants".

The non-natural transgenic plant cell can include an isolated plant cell (e.g., individual plant cells or cells grown in or on an artificial culture medium), or can include a plant cell in undifferentiated tissue (e.g., callus or any aggregation of plant cells). The non-natural transgenic plant cell can include a plant cell in at least one differentiated tissue selected from the group consisting of leaf (e.g., petiole and blade), root, stem (e.g., tuber, rhizome, stolon, bulb, and corm) stalk (e.g., xylem, phloem), wood, seed, fruit (e.g., nut, grain, fleshy fruits), and flower (e.g., stamen, filament, anther, pollen, carpel, pistil, ovary, ovules).

The non-natural transgenic plant cell or non-natural transgenic plant of the invention can be any suitable plant cell or plant of interest. Both transiently transfonmed and stably transformed plant cells are encompassed by this invention. Stably transformed transgenic plants are particularly preferred. In many preferred embodiments, the non-natural transgenic plant is a fertile transgenic plant from which seed can be harvested, and the invention further claims transgenic seed of such transgenic plants, wherein the seed preferably also contains the recombinant construct of this invention.

Making and Using Non-Natural Transgenic Plant Cells and Non-Natural Transgenic Plants Where a recombinant DNA construct of this invention is used to produce a non-natural transgenic plant cell, non-natural transgenic plant, or transgenic seed of this invention, transformation can include any of the well-known and demonstrated methods and compositions. Suitable methods for plant transformation include virtually any method by which DNA can be introduced into a cell, such as by direct delivery of DNA (e.g., by PEG-mediated transformation of protoplasts, by electroporation, by agitation with silicon carbide fibers, and by acceleration of DNA coated particles), by *Agrobacterium*-mediated transformation, by viral or other vectors, etc. One preferred method of plant transformation is microprojectile bombardment, for example, as illustrated in U.S. Pat. No. 5,015,580 (soy), U.S. Pat. No. 5,550,318 (maize), U.S. Pat. No. 5,538,880 (maize), U.S. Pat. No. 6,153,812 (wheat), U.S. Pat. No. 6,160,208 (maize), U.S. Pat. No. 6,288,312 (rice) and U.S. Pat. No. 6,399,861 (maize), and U.S. Pat. No. 6,403,865 (maize), all of which are incorporated by reference.

Another preferred method of plant transformation is *Agrobacterium*-mediated transformation. In one preferred embodiment, the non-natural transgenic plant cell of this invention is obtained by transformation by means of *Agrobacterium* containing a binary Ti plasmid system, wherein the *Agrobacterium* carries a first Ti plasmid and a second, chimeric plasmid containing at least one T-DNA border of a wild-type Ti plasmid, a promoter functional in the transformed plant cell and operably linked to a gene suppression construct of the invention. See, for example, the binary system described in U.S. Pat. No. 5,159,135, incorporated by reference. Also see De Framond (1983) *Biotechnology*, 1:262-269; and Hoekema et al., (1983) *Nature*, 303:179. In such a binary system, the smaller plasmid, containing the T-DNA border or borders, can be conveniently constructed and manipulated in a suitable alternative host, such as *E. coli*, and then transferred into *Agrobacterium*.

Detailed procedures for *Agrobacterium*-mediated transformation of plants, especially crop plants, include, for example, procedures disclosed in U.S. Pat. Nos. 5,004,863, 5,159,135, and 5,518,908 (cotton); U.S. Pat. Nos. 5,416,011, 5,569,834, 5,824,877 and 6,384,301 (soy); U.S. Pat. Nos. 5,591,616 and 5,981,840 (maize); U.S. Pat. No. 5,463,174 (brassicas), and in U.S. Patent Application Publication 2004/0244075 (maize), all of which are incorporated by reference. Similar methods have been reported for many plant species, both dicots and monocots, including, among others, peanut (Cheng et al. (1996) *Plant Cell Rep.*, 15: 653); asparagus (Bytebier et al. (1987) *Proc. Natl. Acad. Sci. U.S.A.*, 84:5345); barley (Wan and Lemaux (1994) *Plant Physiol.*, 104:37); rice (Toriyama et al. (1988) *Bio/Technology*, 6:10; Zhang et al. (1988) *Plant Cell Rep.*, 7:379; wheat (Vasil et al. (1992) *Bio/Technology*, 10:667; Becker et al. (1994) *Plant J.*, 5:299), alfalfa (Masoud et al. (1996) *Transgen. Res.*, 5:313); and tomato (Sun et al. (2006) *Plant Cell Physiol.*, 47:426-431). See also a description of vectors, transformation methods, and production of transformed *Arabidopsis thaliana* plants where transcription factors are constitutively expressed by a CaMV35S promoter, in U.S. Patent Application Publication 2003/0167537 A1, incorporated by reference. Transgenic plant cells and transgenic plants can also be obtained by transformation with other vectors, such as, but not limited to, viral vectors (e.g., tobacco etch potyvirus (TEV), barley stripe mosaic virus (BSMV), and the viruses referenced in Edwardson and Christie, "The Potyvirus Group: Monograph No. 16, 1991, Agric. Exp. Station, Univ. of Florida), plasmids, cosmids, YACs (yeast artificial chromosomes), BACs (bacterial artificial chromosomes) or any other suitable cloning vector, when used with an appropriate transformation protocol, e.g., bacterial infection (e.g., with *Agrobacterium* as described above), binary bacterial artificial chromosome constructs, direct delivery of DNA (e.g., via PEG-mediated transformation, desiccation/inhibition-mediated DNA uptake, electroporation, agitation with silicon carbide fibers, and microprojectile bombardment). It would be clear to one of ordinary skill in the art that various transformation methodologies can be used and modified for production of stable transgenic plants from any number of plant species of interest.

Transformation methods to provide transgenic plant cells and transgenic plants containing stably integrated recombinant DNA are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos or parts of embryos, and gametic cells such as microspores, pollen, sperm, and egg cells. Any cell from which a fertile plant can be regenerated is contemplated as a useful recipient cell for practice of the invention. Callus can be initiated from various tissue sources, including, but not limited to, immature embryos or parts of embryos, seedling apical meristems, microspores, and the like. Those cells which are capable of proliferating as callus can serve as recipient cells for genetic transformation. Practical transformation methods and materials for making non-natural transgenic plants of this invention (e.g., various media and recipient target cells, transformation of immature embryos, and subsequent regeneration of fertile transgenic plants) are disclosed, for example, in U.S. Pat. Nos. 6,194,636 and 6,232,526 and U.S. Patent Application Publication 2004/0216189, which are incorporated by reference. Transgenic plants include transgenic plant tissue or parts, such as transgenic rootstock or transgenic graft or scion material, which can be used in combination with non-transgenic plant tissue or parts.

In general transformation practice, DNA is introduced into only a small percentage of target cells in any one transformation experiment. Marker genes are generally used to provide an efficient system for identification of those cells that are stably transfonmed by receiving and integrating a transgenic DNA construct into their genomes. Preferred marker genes provide selective markers which confer resistance to a selective agent, such as an antibiotic or herbicide. Any of the antibiotics or herbicides to which a plant cell may be resistant can be a useful agent for selection. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the recombinant DNA. Commonly used selective marker genes include those conferring resistance to antibiotics such as kanamycin or paromomycin (nptII), hygromycin B (aph IV) and gentamycin (aac3 and aacC4) or resistance to herbicides such as glufosinate (bar or pat) and glyphosate (EPSPS). Examples of useful selective marker genes and selection agents are illustrated in U.S. Pat. Nos. 5,550,318, 5,633,435, 5,780,708, and 6,118,047, all of which are incorporated by reference. Screenable markers or reporters, such as markers that provide an ability to visually identify transformants can also be employed. Non-limiting examples of useful screenable markers include, for example, a gene expressing a protein that produces a detectable color by acting on a chromogenic substrate (e.g., beta-glucuronidase (GUS) (uidA) or luciferase (luc)) or that itself is detectable, such as green fluorescent protein (GFP) (gfp) or an immunogenic molecule. Those of skill in the art will recognize that many other useful markers or reporters are available for use.

Detecting or measuring the resulting change in expression of the target gene (or concurrent expression of a gene of interest) obtained by transcription of the recombinant construct in the non-natural transgenic plant of the invention can be achieved by any suitable methods, including protein detection methods (e.g., western blots, ELISAs, and other immunochemical methods), measurements of enzymatic activity, or nucleic acid detection methods (e.g., Southen blots, northern blots, PCR, RT-PCR, fluorescent in situ hybridization). Such methods are well known to those of ordinary skill in the art as evidenced by the numerous handbooks available; see, for example, Joseph Sambrook and David W. Russell, "Molecular Cloning: A Laboratory Manual" (third edition), Cold Spring Harbor Laboratory Press, NY, 2001; Frederick M. Ausubel et al. (editors) "Short Protocols in Molecular Biology" (fifth edition), John Wiley and Sons, 2002; John M. Walker (editor) "Protein Protocols Handbook" (second edition), Humana Press, 2002; and Leandro Pena (editor) "Transgenic Plants: Methods and Protocols", Humana Press, 2004.

Other suitable methods for detecting or measuring the resulting change in expression of the target gene (or concurrent expression of a gene of interest) obtained by transcription of the recombinant DNA in the non-natural transgenic plant of the invention include measurement of any other trait that is a direct or proxy indication of expression of the target gene (or concurrent expression of a gene of interest) in the transgenic plant in which the recombinant DNA is transcribed, relative to one in which the recombinant DNA is not transcribed, e.g., gross or microscopic morphological traits, growth rates, yield, reproductive or recruitment rates, resistance to pests or pathogens, or resistance to biotic or abiotic stress (e.g., water deficit stress, salt stress, nutrient stress, heat or cold stress). Such methods can use direct measurements of a phenotypic trait or proxy assays (e.g., in plants, these assays include plant part assays such as leaf or root assays to determine tolerance of abiotic stress).

The recombinant DNA constructs of the invention can be stacked with other recombinant DNA for imparting additional traits (e.g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, incorporated by reference.

Seeds of transgenic, fertile plants can be harvested and used to grow progeny generations, including hybrid generations, of non-natural transgenic plants of this invention that include the recombinant DNA construct in their genome. Thus, in addition to direct transformation of a plant with a recombinant DNA construct, non-natural transgenic plants of the invention can be prepared by crossing a first plant having the recombinant DNA with a second plant lacking the construct. For example, the recombinant DNA can be introduced into a plant line that is amenable to transformation to produce a non-natural transgenic plant, which can be crossed with a second plant line to introgress the recombinant DNA into the resulting progeny. A non-natural transgenic plant of the invention with one recombinant DNA (effecting change in expression of a target gene) can be crossed with a plant line having other recombinant DNA that confers one or more additional trait(s) (such as, but not limited to, herbicide resistance, pest or disease resistance, environmental stress resistance, modified nutrient content, and yield improvement) to produce progeny plants having recombinant DNA that confers both the desired target sequence expression behavior and the additional trait(s).

Typically, in such breeding for combining traits the transgenic plant donating the additional trait is a male line and the transgenic plant carrying the base traits is the female line. The progeny of this cross segregate such that some of the plant will carry the DNA for both parental traits and some will carry DNA for one parental trait; such plants can be identified by markers associated with parental recombinant DNA Progeny plants carrying DNA for both parental traits can be crossed back into the female parent line multiple times, e.g., usually 6 to 8 generations, to produce a progeny plant with substantially the same genotype as one original transgenic parental line but for the recombinant DNA of the other transgenic parental line.

Yet another aspect of the invention is a non-natural transgenic plant grown from the transgenic seed of the invention. This invention contemplates non-natural transgenic plants grown directly from transgenic seed containing the recombinant DNA as well as progeny generations of plants, including inbred or hybrid plant lines, made by crossing a transgenic plant grown directly from transgenic seed to a second plant not grown from the same transgenic seed.

Crossing can include, for example, the following steps:
(a) plant seeds of the first parent plant (e.g., non-transgenic or a transgenic) and a second parent plant that is transgenic according to the invention;
(b) grow the seeds of the first and second parent plants into plants that bear flowers;
(c) pollinate a flower from the first parent with pollen from the second parent; and
(d) harvest seeds produced on the parent plant bearing the fertilized flower.

It is often desirable to introgress recombinant DNA into elite varieties, e.g., by backcrossing, to transfer a specific desirable trait from one source to an inbred or other plant that lacks that trait. This can be accomplished, for example, by first crossing a superior inbred ("A") (recurrent parent) to a donor inbred ("B") (non-recurrent parent), which carries the appropriate gene(s) for the trait in question, for example, a construct prepared in accordance with the current invention. The progeny of this cross first are selected in the resultant progeny for the desired trait to be transferred from the non-recurrent parent "B", and then the selected progeny are mated back to the superior recurrent parent "A". After five or more backcross generations with selection for the desired trait, the progeny are hemizygous for loci controlling the characteristic being transferred, but are like the superior parent for most or almost all other genes. The last backcross generation would be selfed to give progeny which are pure breeding for the gene(s) being transferred, i.e., one or more transformation events.

Through a series of breeding manipulations, a selected DNA construct can be moved from one line into an entirely different line without the need for further recombinant manipulation. One can thus produce inbred plants which are true breeding for one or more DNA constructs. By crossing different inbred plants, one can produce a large number of different hybrids with different combinations of DNA constructs. In this way, plants can be produced which have the desirable agronomic properties frequently associated with hybrids ("hybrid vigor"), as well as the desirable characteristics imparted by one or more DNA constructs.

Genetic markers can be used to assist in the introgression of one or more DNA constructs of the invention from one genetic background into another. Marker assisted selection offers advantages relative to conventional breeding in that it can be used to avoid errors caused by phenotypic variations. Further, genetic markers can provide data regarding the relative degree of elite germplasm in the individual progeny of a particular cross. For example, when a plant with a desired trait which otherwise has a non-agronomically desirable genetic background is crossed to an elite parent, genetic markers can be used to select progeny which not only possess the trait of interest, but also have a relatively large proportion of the desired germplasm. In this way, the number of generations required to introgress one or more traits into a particular genetic background is minimized. The usefulness of marker assisted selection in breeding non-natural transgenic plants of the current invention, as well as types of useful molecular markers, such as but not limited to SSRs and SNPs, are discussed in PCT Application Publication WO 02/062129 and U.S. Patent Application Publications Numbers 2002/0133852, 2003/0049612, and 2003/0005491, each of which is incorporated by reference in their entirety.

In certain non-natural transgenic plant cells and non-natural transgenic plants of the invention, it may be desirable to concurrently express (or suppress) a gene of interest while also regulating expression of a target gene. Thus, in some embodiments, the non-natural transgenic plant contains recombinant DNA further including a gene expression (or suppression) element for expressing at least one gene of interest, and regulation of expression of a target gene is preferably effected with concurrent expression (or suppression) of the at least one gene of interest in the transgenic plant.

Thus, as described herein, the non-natural transgenic plant cells or non-natural transgenic plants of the invention can be obtained by use of any appropriate transient or stable, integrative or non-integrative transformation method known in the art or presently disclosed. The recombinant DNA constructs can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Non-limiting examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, papaya, avocado, and berries; and ornamental plants including ornamental flowering plants, ornamental trees and shrubs, ornamental groundcovers, and ornamental grasses. Preferred dicot plants include, but are not limited to, canola, broccoli, cabbage, carrot, cauliflower, Chinese cabbage, cucumber, dry beans, eggplant, fennel, garden beans, gourds, lettuces, melons, okra, peas, peppers, pumpkin, radishes, spinach, squash, watermelon, cotton, potato, quinoa, amaranth, buckwheat, safflower, soybean, sugarbeet, and sunflower. Preferred monocots include, but are not limited to, wheat, oat, barley, maize (including sweet corn and other varieties), rye, triticale, rice, ornamental and forage grasses, sorghum, millet, onions, leeks, and sugarcane, more preferably maize, wheat, and rice.

The ultimate goal in plant transformation is to produce plants which are useful to man. In this respect, non-natural transgenic plants of the invention can be used for virtually any purpose deemed of value to the grower or to the consumer. For example, one may wish to harvest the transgenic plant itself, or harvest transgenic seed of the transgenic plant for planting purposes, or products can be made from the transgenic plant or its seed such as oil, starch, ethanol or other fermentation products, animal feed or human food, pharmaceuticals, and various industrial products. For example, maize is used extensively in the food and feed industries, as well as in industrial applications. Further discussion of the uses of maize can be found, for example, in U.S. Pat. Nos. 6,194,636, 6,207,879, 6,232,526, 6,426,446, 6,429,357, 6,433,252, 6,437,217, and 6,583,338, incorporated by reference, and PCT Publications WO 95/06128 and WO 02/057471. Thus, this invention also provides commodity products produced from a transgenic plant cell, plant, or seed of this invention, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed of this invention. The detection of one or more of nucleic acid sequences of the recombinant DNA constructs of this invention in one or more commodity or commodity products contemplated herein is de facto evidence that the commodity or commodity product contains or is derived from a transgenic plant cell, plant, or seed of this invention.

In preferred embodiments, the non-natural transgenic plant prepared from the non-natural transgenic plant cell of this invention, i.e., a transgenic plant having in its genome a recombinant DNA construct of this invention has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen or other nutrients;
(h) modified agronomic characteristics;
(i) modified growth or reproductive characteristics; and
(j) improved harvest, storage, or processing quality.

In particularly preferred embodiments, the non-natural transgenic plant is characterized by: improved tolerance of abiotic stress (e.g., tolerance of water deficit or drought, heat, cold, non-optimal nutrient or salt levels, non-optimal light levels) or of biotic stress (e.g., crowding, allelopathy, or wounding); by a modified primary metabolite (e.g., fatty acid, oil, amino acid, protein, sugar, or carbohydrate) composition; a modified secondary metabolite (e.g., alkaloids, terpenoids, polyketides, non-ribosomal peptides, and secondary metabolites of mixed biosynthetic origin) composition; a modified trace element (e.g., iron, zinc), carotenoid (e.g., beta-carotene, lycopene, lutein, zeaxantlin, or other carotenoids and xanthophylls), or vitamin (e.g., tocopherols) composition; improved yield (e.g., improved yield under non-stress conditions or improved yield under biotic or abiotic stress); improved ability to use nitrogen or other nutrients; modified agronomic characteristics (e.g., delayed ripening; delayed senescence; earlier or later maturity; improved shade tolerance; improved resistance to root or stalk lodging; improved resistance to "green snap" of stems; modified photoperiod response); modified growth or reproductive characteristics (e.g., intentional dwarfing; intentional male sterility, useful, e.g., in improved hybridization procedures; improved vegetative growth rate; improved germination; improved male or female fertility); improved harvest, storage, or processing quality (e.g., improved resistance to pests during storage, improved resistance to breakage, improved appeal to consumers); or any combination of these traits.

In one preferred embodiment, transgenic seed, or seed produced by the non-natural transgenic plant, has modified primary metabolite (e.g., fatty acid, oil, amino acid, protein, sugar, or carbohydrate) composition, a modified secondary metabolite (e.g., alkaloids, terpenoids, polyketides, non-ribosomal peptides, and secondary metabolites of mixed biosynthetic origin) composition, a modified trace element (e.g., iron, zinc), carotenoid (e.g., beta-carotene, lycopene, lutein, zeaxantlin, or other carotenoids and xanthophylls), or vitamin (e.g., tocopherols,) composition, an improved harvest, storage, or processing quality, or a combination of these. For example, it can be desirable to modify the amino acid (e.g., lysine, methionine, tryptophan, or total protein), oil (e.g., fatty acid composition or total oil), carbohydrate (e.g., simple sugars or starches), trace element, carotenoid, or vitamin content of seeds of crop plants (e.g., canola, cotton, safflower, soybean, sugarbeet, sunflower, wheat, maize, or rice), preferably in combination with improved seed harvest, storage, or processing quality, and thus provide improved seed for use in animal feeds or human foods. In another instance, it can be desirable to change levels of native components of the transgenic plant or seed of a transgenic plant, for example, to decrease levels of proteins with low levels of lysine, methionine, or tryptophan, or to increase the levels of a desired amino acid or fatty acid, or to decrease levels of an allergenic protein or glycoprotein (e.g., peanut allergens including ara h 1, wheat allergens including gliadins and glutenins, soybean allergens including P34 allergen, globulins, glycinins, and conglycinins) or of a toxic metabolite (e.g., cyanogenic glycosides in cassava, solanum alkaloids in members of the Solanaceae).

Methods of Gene Suppression

A further aspect of this invention provides a method of effecting gene suppression, including the steps of: (a) providing a non-natural transgenic plant including a regenerated plant prepared from a non-natural transgenic plant cell of this invention, or a progeny plant of the regenerated plant (as described above under the heading "Transgenic Plant Cells and Plants"); and (b) transcribing the recombinant DNA construct in the non-natural transgenic plant; wherein the transcribing produces RNA that is capable of suppressing the at least one target gene in the non-natural transgenic plant, and whereby the at least one target gene is suppressed relative to its expression in the absence of transcription of the recombinant DNA construct.

The at least one target gene is at least one gene selected from the group consisting of a gene native to the transgenic plant, a transgene in the transgenic plant, and a gene native to a viral, a bacterial, a fungal, or an invertebrate pest or pathogen of the transgenic plant. Suitable target genes are described above under the heading "Target Genes". In some embodiments, the at least one target gene is a single target gene. In other embodiments, the at least one target gene is multiple target genes. Suppression of a target gene includes non-specific suppression, e.g., constitutive expression, as well as specific expression, e.g., spatially specific, temporally specific, developmentally specific, or inducible gene suppression. Specificity of suppression of the at least one target gene is achieved by techniques known to those skilled in the art, such as by selecting a promoter having the desired specific expression pattern, or by selecting a microRNA recognition site that is recognized by a mature miRNA having the desired specific expression pattern.

Transcription of the recombinant DNA construct is carried out by means known in the art. In some embodiments, transcription is constitutive or non-specific, e.g., under the control of a constitutive promoter. In other embodiments, transcription occurs under specific spatial, temporal, or inducible conditions. For example, the recombinant DNA construct can include a spatially, temporally, or inducible specific promoter. In another example, the recombinant DNA construct can include a riboswitch (DNA that transcribes to an RNA aptamer capable of binding to a ligand, and DNA that transcribes to regulatory RNA capable of regulating expression of the target gene, wherein the regulation is dependent on the conformation of the regulatory RNA, and the conformation of the regulatory RNA is allosterically affected by the binding state of the RNA aptamer) thereby allowing transcription of the recombinant DNA construct to be controlled by the binding state of the RNA aptamer and thus the presence (or absence) of the ligand.

This invention further provides a method of concurrently effecting gene suppression of at least one target gene and gene expression of at least one gene of interest, including the steps of: (a) providing a non-natural transgenic plant including a regenerated plant prepared from the non-natural transgenic plant cell of this invention, or a progeny plant of the regenerated plant (as described above under the heading "Transgenic Plant Cells and Plants"), wherein the recombinant DNA construct further includes a gene expression element for expressing the at least one gene of interest; and (b) transcribing the recombinant DNA construct in the non-natural transgenic plant, wherein, when the recombinant DNA construct is transcribed in the non-natural transgenic plant, transcribed RNA that is capable of suppressing the at least one target gene and transcribed RNA encoding the at least one gene of interest are produced, whereby the at least one target gene is suppressed relative to its expression in the absence of transcription of the recombinant DNA construct and the at least one gene of interest is concurrently expressed.

A gene of interest can include any coding or non-coding sequence from any species (including, but not limited to, non-eukaryotes such as bacteria, and viruses; fungi; plants, including monocots and dicots, such as crop plants, ornamental plants, and non-domesticated or wild plants; invertebrates such as arthropods, annelids, nematodes, and molluscs; and vertebrates such as amphibians, fish, birds, and mammals. Non-limiting examples of a non-coding sequence to be expressed by a gene expression element include, but not limited to, 5' untranslated regions, promoters, enhancers, or other non-coding transcriptional regions, 3' untranslated regions, terminators, intron, microRNAs, microRNA precursor DNA sequences, small interfering RNAs, RNA components of ribosomes or ribozymes, small nucleolar RNAs, RNA aptamers capable of binding to a ligand, and other non-coding RNAs. Non-limiting examples of a gene of interest further include, but are not limited to, translatable (coding) sequence, such as genes encoding transcription factors and genes encoding enzymes involved in the biosynthesis or catabolism of molecules of interest (such as amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin). A gene of interest can be a gene native to the cell (e.g., a plant cell) in which the recombinant DNA construct of the invention is to be transcribed, or can be a non-native gene. A gene of interest can be a marker gene, for example, a selectable marker gene encoding antibiotic, antifungal, or herbicide resistance, or a marker gene encoding an easily detectable trait (e.g., in a plant cell, phytoene synthase or other genes imparting a particular pigment to the plant), or a gene encoding a detectable molecule, such as a fluorescent protein, luciferase, or a unique polypeptide or nucleic acid "tag" detectable by protein or nucleic acid detection methods, respectively). Selectable markers are genes of interest of particular utility in identifying successful processing of constructs of the invention. Genes of interest include those genes also described above as target genes, under the heading "Target Genes".

The gene of interest to be expressed by the gene expression element can include at least one gene selected from the group consisting of a eukaryotic target gene, a non-eukaryotic target gene, and a microRNA precursor DNA sequence. The gene of interest can include a single gene or multiple genes (such as multiple copies of a single gene, multiple alleles of a single gene, or multiple genes including genes from multiple species). In one embodiment, the gene expression element can include self-hydrolyzing peptide sequences, e.g., located between multiple sequences coding for ono or more polypeptides (see, for example, the 2A and "2A-like" self-cleaving sequences from various species, including viruses, trypanosomes, and bacteria, disclosed by Donnelly et al. (2001), *J. Gen. Virol.*, 82:1027-1041). In another embodiment, the gene expression element can include ribosomal "skip" sequences, e.g., located between multiple sequences coding for one or more polypeptides (see, for example, the aphthovirus foot-and-mouth disease virus (FMDV) 2A ribosomal "skip" sequences disclosed by Donnelly et al. (2001), *J. Gen. Virol.*, 82:1013-1025).

Abiotic-Stress-Responsive miRNAs

A further aspect of this invention is directed to miRNAs that exhibit an expression pattern that is responsive to abiotic stress, for example, a miRNA that exhibits an expression pattern characterized by regulation of the miRNA by nutrient stress, a miRNA that exhibits an expression pattern characterized by regulation of the miRNA by water stress, or a miRNA that exhibits an expression pattern characterized by regulation of the miRNA by temperature stress.

Examples 6-11 describe a novel miRNA that was identified in crop plants and assigned the trivial name miRMON18, which exhibits an expression pattern characterized by suppression of the miRNA under nutrient stress (i.e., nitrogen deficiency, phosphate deficiency, or both nitrogen and phosphate deficiency). The mature miRMON18 is a 21-nucleotide miRNA with the sequence UUAGAUGACCAUCAG-CAAACA and was cloned from rice (SEQ ID NO. 393), maize (SEQ ID NO. 3227), and soybean (SEQ ID NO. 8742) small RNA libraries. Precursor sequences were identified in rice (SEQ ID NO. 1763) and in maize (SEQ ID NO. 3936).

Recombinant DNA constructs of this invention are described in detail under the heading "Recombinant DNA Constructs" above and are useful with any of the miRNAs disclosed herein, for example, a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819. The description of recombinant DNA constructs of this invention also applies generally to embodiments of this invention that are more specifically directed to a miRNAs having a particular expression pattern, such as a nutrient-stress-responsive plant miRNA (e.g., miRMON18 and other miRNAs described in the Examples) as described in this section. The following description is directed to miRMON18 but is also applicable to other miRNAs regulated by abiotic stress, especially a miRNAs that exhibits an expression pattern characterized by suppression of the miRNA under nutrient stress, a miRNA that exhibits an expression pattern characterized by suppression of the miRNA under water stress, or a miRNA that exhibits an expression pattern characterized by suppression of the miRNA under temperature stress; non-limiting examples of miRNAs regulated by abiotic stress include miR399 and miR319.

Thus, this invention provides a recombinant DNA construct including at least one transcribable DNA element for modulating the expression of at least one target gene, wherein the at least one transcribable DNA element is selected from the group consisting of: (a) a DNA element that transcribes to an miRNA precursor with the fold-back structure of a miRMON18 precursor sequence selected from SEQ ID NO. 1763 and SEQ ID NO. 3936 and is processed to a mature miRMON18 miRNA having the sequence of UUAGAUGAC-CAUCAGCAAACA (SEQ ID NO. 393, SEQ ID NO. 3227, or SEQ ID NO. 8742); (b) a DNA element that transcribes to an engineered miRNA precursor derived from the fold-back structure of a miRMON18 precursor sequence selected from SEQ ID NO. 1763 and SEQ ID NO. 3936, wherein the engineered miRNA precursor includes a modified mature miRMON18 miRNA; (c) a DNA element that is located within or adjacent to a transgene transcription unit and that is transcribed to RNA including a miRNA recognition site recognized by a mature miRNA derived from a miRMON18 precursor sequence selected from SEQ ID NO. 1763 and SEQ ID NO. 3936; and (d) a DNA element for suppressing expression of an endogenous miRNA derived from a miRMON18 precursor sequence selected from SEQ ID NO. 1763 and SEQ ID NO. 3936. These embodiments directed to miRMON18 are described in more detail below.

(A) Expression of a Native miRMON18 Under Non-Native Conditions.

This invention provides a recombinant DNA construct including at least one transcribable DNA element for modulating the expression of at least one target gene, wherein the at least one transcribable DNA element includes a DNA element that transcribes to a miRNA precursor with the fold-back structure of a miRMON18 precursor sequence selected from SEQ ID NO. 1763 and SEQ ID NO. 3936 and is processed to a mature miRMON18 miRNA having the sequence of SEQ ID NO. 393, SEQ ID NO. 3227, or SEQ ID NO. 8742, and the at least one target gene is an endogenous gene of a plant, and wherein expression of the recombinant DNA construct in the plant results in suppression of the at least one target gene. In one preferred embodiment, the miRNA precursor includes a contiguous segment of at least 90% of the nucleotides of the miRMON18 precursor sequence. Such constructs are especially useful for expression of miRMON18 in an expression pattern other than the native miRMON18 expression pattern (e.g., in different tissues, at different times, or at different levels of expression).

The miRMON18 precursor need not include all of the nucleotides contained in a miRMON18 precursor sequence selected from SEQ ID NO. 1763 and SEQ ID NO. 3936, but preferably includes a contiguous segment of at least 80%, or at least 85%, or at least 90%, or at least 95%, or at least 97%, or at least 98%, or at least 99% of the nucleotides of a miRMON18 precursor sequence selected from SEQ ID NO. 1763 and SEQ ID NO. 3936. In a preferred embodiment, the miRNA precursor includes a contiguous segment of at least 90% of the nucleotides of a miRMON18 precursor sequence selected from SEQ ID NO. 1763 and SEQ ID NO. 3936. Regardless of the specific nucleotide sequence employed, the miRMON18 precursor forms a fold-back structure that is identical or near-identical to the fold-back structure formed by amiRMON18 precursor sequence selected from SEQ ID NO. 1763 and SEQ ID NO. 3936 and is processed in vivo by one or more steps to a mature miRMON18 miRNA having the sequence of SEQ ID NO. 393, SEQ ID NO. 3227, or SEQ ID NO. 8742.

In preferred embodiments, the at least one target gene is an endogenous gene of a plant that includes at least one miRMON18 recognition site (target site), and expression of the recombinant DNA construct in the plant results in suppression of the at least one target gene. In preferred embodiments, the at least one target gene is an endogenous gene of a plant, and thus expression of the recombinant DNA construct in the plant results in suppression of the at least one target gene. In preferred embodiments, the recombinant DNA construct further includes a promoter other than a native miRMON18 promoter. This permits expression of the mature miRMON18 miRNA under spatial or temporal or inducible conditions under which it would not natively be expressed. For example, the recombinant DNA construct can be designed to include a constitutive promoter and thus constitutively express a mature miRMON18 that has an expression pattern characterized by suppression of the miRNA under nutrient stress (i.e., nitrogen deficiency, phosphate deficiency, or both nitrogen and phosphate deficiency); this would result in constitutive suppression of the miRMON18 target gene. In another example, the recombinant DNA construct can be designed to include an inducible root-specific promoter and thus express a mature miRMON18 in root upon induction; this would result in suppression of the miRMON18 target gene in root tissue upon induction. Promoters that are useful with this recombinant DNA construct are described under the heading "Promoters".

(B) Expression of an Engineered Mature miRNA Derived from miRMON18.

In another embodiment, the recombinant DNA construct includes at least one transcribable DNA element for modulating the expression of at least one target gene, wherein the at least one transcribable DNA element for modulating the expression of at least one target gene includes a DNA element that transcribes to an engineered miRNA precursor derived from the fold-back structure of a miRMON18 precursor sequence selected from SEQ ID NO. 1763 and SEQ ID NO. 3936, wherein the engineered miRNA precursor includes a modified mature miRMON18 miRNA, wherein the at least one target gene is an endogenous gene of a plant or an endogenous gene of a pest or pathogen of the plant, and wherein expression of the recombinant DNA construct in the plant results in suppression of the at least one target gene.

In preferred embodiments, the at least one target gene is an endogenous gene of a plant or an endogenous gene of a pest or pathogen of the plant, and expression of the recombinant DNA construct in the plant results in suppression of the at least one target gene. Suitable target genes are described above under the heading "Target Genes". By "engineered" is meant that nucleotides are changed (substituted, deleted, or added) in a native miRMON18 precursor sequence selected from SEQ ID NO. 1763 and SEQ ID NO. 3936, thereby resulting in an engineered miRNA precursor having substantially the same the fold-back structure as the native miRMON18 precursor sequence, but wherein the mature miRNA that is processed from the engineered miRMON18 precursor has a modified sequence (i.e., different from that of the native mature miRMON18) that is designed to suppress a target gene different from the target genes natively suppressed by the native miRMON18 precursor sequence. A general, non-limiting method for determining nucleotide changes in the native miRMON18 precursor sequence to produce the engineered miRNA precursor is described above under the heading "Expression of an engineered mature miRNA".

(C) Expression of a Transgene and a miRMON18 Recognition Site.

In another embodiment, the recombinant DNA construct includes at least one transcribable DNA element for modulating the expression of at least one target gene, and further includes a transgene transcription unit, wherein the at least one transcribable DNA element for modulating the expression of at least one target gene includes a DNA element that is located within or adjacent to the transgene transcription unit and that is transcribed to RNA including a miRNA recognition site recognized by a mature miRMON18 miRNA having the sequence of SEQ ID NO. 393, SEQ ID NO. 3227, or SEQ ID NO. 8742 or by a mature miRMON18 miRNA derived from a miRMON18 precursor sequence selected from SEQ ID NO. 1763 and SEQ ID NO. 3936, and the at least one target gene includes the transgene encoded by the transgene transcription unit, and wherein expression of the recombinant DNA construct in a plant results in expression of the transgene in cells of the plant wherein the mature miRMON18 miRNA is not natively expressed. Prediction of a miRMON18 recognition site is achieved using methods known in the art, such as sequence complementarity rules as described by Zhang (2005) *Nucleic Acids Res.*, 33:W701-704 and by Rhoades et al. (2002) *Cell*, 110:513-520; non-limiting examples of miRMON18 recognition sites are provided in the working Examples below.

Prediction of a miRMON18 recognition site permits identification and validation of endogenous genes regulated by a mature miRMON18 from a natively expressed miRMON18 precursor; this is useful, e.g., to eliminate or modify a miRMON18 recognition site in an endogenous gene in order to decouple expression of that gene from regulation by the endogenous miRMON18 that natively regulates expression of the gene. In one embodiment, the number of mismatches (especially those corresponding to positions 2 to 13 of the mature miRMON18) between a miRMON18 recognition site and a mature miRMON18 can be increased to prevent recognition and cleavage by an endogenous miRMON18.

These recombinant DNA constructs are particularly useful for in planta expression of the transgene to be restricted according to the endogenous expression of miRMON18, that is, the transgene is expressed when miRMON18 is suppressed, such as under nutrient stress (i.e., nitrogen deficiency, phosphate deficiency, or both nitrogen and phosphate deficiency). Expression of the transgene can be further controlled by use of an appropriate promoter. In a non-limiting example, a recombinant DNA construct of this invention that encodes (a) a transgene under the control of a root-specific promoter and (b) a miRNA recognition site recognized by a mature miRMON18 that is specifically suppressed only under conditions of nitrogen (or phosphate) deficiency is used for expression of the transgene in roots of a plant under nitrogen-deficient (or phosphate-deficient) conditions.

The transgene transcription unit includes at least a transgene, and optionally additional sequence such as, but not limited to, a promoter, a promoter enhancer, a terminator, messenger RNA stabilizing or destabilizing sequence (see, e.g., Newman et al. (1993) *Plant Cell,* 5:701-714; Green (1993) *Plant Physiol.,* 102:1065-1070; and Ohme-Takagi et al. (1993) *Proc. Natl. Acad. Sci. USA,* 90:11811-11815), sequence for localization or transport of the transgene transcript to a specific locale (e.g., mitochondrion, plastid, nucleolus, peroxisome, endoplasmic reticulum, etc.), or other sequence related to the desired processing of the transgene. The transgene encoded by the transgene transcription unit can include any one or more genes of interest, including coding sequence, non-coding sequence, or both. Genes of interest can include any of the genes listed under "Target Genes", preferred examples of which include translatable (coding) sequence for genes encoding transcription factors and genes encoding enzymes involved in the biosynthesis or catabolism of molecules of interest (such as, but not limited to, amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin).

(D) Suppression of an Endogenous or Native miRMON18.

In another embodiment, the recombinant DNA construct includes at least one transcribable DNA element for modulating the expression of at least one target gene, wherein the at least one transcribable DNA element includes a DNA element for suppressing expression of an endogenous mature miRMON18 miRNA derived from a miRMON18 precursor sequence selected from SEQ ID NO. 1763 and SEQ ID NO. 3936, wherein the at least one target gene is an endogenous gene of a plant, and wherein expression of the endogenous gene is suppressed in cells of the plant where native expression of the endogenous mature miRMON18 miRNA occurs, and wherein expression of the recombinant DNA construct in the cells results in expression of the endogenous gene in the cells. Such constructs are especially useful for suppression of a native or endogenous miRMON18 and thus for permitting expression of genes that have one or more miRMON18 recognition sites. In preferred embodiments, the at least one target gene is an endogenous gene of a plant and includes one or more miRMON18 recognition sites, and expression of the endogenous gene is suppressed in cells of the plant where native expression of the mature miRMON18 occurs, and thus expression of the recombinant DNA construct in the cells results in expression of the endogenous target gene in the cells.

The DNA element for suppressing expression includes at least one of:
(a) DNA that includes at least one anti-sense DNA segment that is anti-sense to at least one segment of the target gene;
(b) DNA that includes multiple copies of at least one anti-sense DNA segment that is anti-sense to at least one segment of the target gene;
(c) DNA that includes at least one sense DNA segment that is at least one segment of the target gene;
(d) DNA that includes multiple copies of at least one sense DNA segment that is at least one segment of the target gene;
(e) DNA that transcribes to RNA for suppressing the target gene by forming double-stranded RNA and includes at least one anti-sense DNA segment that is anti-sense to at least one segment of the target gene and at least one sense DNA segment that is at least one segment of the target gene;
(f) DNA that transcribes to RNA for suppressing the target gene by forming a single double-stranded RNA and includes multiple serial anti-sense DNA segments that are anti-sense to at least one segment of the target gene and multiple serial sense DNA segments that are at least one segment of the target gene;
(g) DNA that transcribes to RNA for suppressing the target gene by forming multiple double strands of RNA and includes multiple anti-sense DNA segments that are anti-sense to at least one segment of the target gene and multiple sense DNA segments that are at least one segment of the target gene, and wherein the multiple anti-sense DNA segments and the multiple sense DNA segments are arranged in a series of inverted repeats;
(h) DNA that includes nucleotides derived from a plant miRNA;
(i) DNA that includes nucleotides of a siRNA;
(j) DNA that transcribes to an RNA aptamer capable of binding to a ligand; and
(k) DNA that transcribes to an RNA aptamer capable of binding to a ligand, and DNA that transcribes to regulatory RNA capable of regulating expression of the target gene, wherein the regulation is dependent on the conformation of the regulatory RNA, and the conformation of the regulatory RNA is allosterically affected by the binding state of the RNA aptamer.

DNA elements for suppressing expression are described further in Example 3 and depicted in FIGS. 2 and 3. The effects of a miRNA on its target gene can also be controlled by alternative methods described in detail below under "MicroRNA Decoy Sequences".

In some embodiments, the recombinant DNA construct includes DNA designed to be transcribed to single-stranded RNA or to at least partially double-stranded RNA (such as in a "kissing stem-loop" arrangement), or to an RNA that assumes a secondary structure or three-dimensional configuration (e.g., a large loop of antisense sequence of the target gene or an aptamer) that confers on the transcript an additional desired characteristic, such as increased stability, increased half-life in vivo, or cell or tissue specificity. In one example, the spacer is transcribed to a stabilizing loop that links the first and second series of contiguous RNA segments (see, for example, Di Giusto and King (2004) *J. Biol. Chem.*, 279:46483-46489). In another example, the recombinant DNA construct includes DNA that transcribes to RNA including an RNA aptamer (e.g., an aptamer that binds to a cell-specific ligand) that allows cell- or tissue-specific targetting of the recombinant RNA duplex.

(E) miRNA-Unresponsive Transgenes, Including miR-MON18-Unresponsive Transgenes.

Also disclosed and claimed is a recombinant DNA construct including a synthetic miRNA-unresponsive transgene sequence that is unresponsive to a given mature miRNA, wherein the synthetic miRNA-unresponsive transgene sequence is: (a) derived from a natively miRNA-responsive sequence by deletion or modification of all native miRNA recognition sites recognized by the given mature miRNA within the natively miRNA-responsive sequence, and (b) is not recognized by the given mature miRNA. Non-limiting embodiments include a recombinant DNA construct including a synthetic miRNA-unresponsive transgene sequence that is unresponsive to a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or unresponsive to a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819, wherein the synthetic miRNA-unresponsive transgene sequence is: (a) derived from a natively miRNA-responsive sequence by deletion or modification of all native miRNA recognition sites recognized by the given mature miRNA within the natively miRNA-responsive sequence, and (b) is not recognized by the given mature miRNA. Prediction of a recognition site is achieved using methods known in the art, such as sequence complementarity rules as described by Zhang (2005) *Nucleic Acids Res.*, 33:W701-704 and by Rhoades et al. (2002) *Cell*, 110:513-520.

One non-limiting preferred embodiment is a recombinant DNA construct including a synthetic miRMON18-unresponsive transgene sequence, wherein the synthetic miRMON18-unresponsive transgene sequence is: (a) derived from a natively miRMON18-responsive sequence by deletion or modification of all native miRMON18 miRNA recognition sites (that is to say, deletion or modification of any recognition site that is recognized by a mature miRMON18 miRNA having the sequence of SEQ ID NO. 393, SEQ ID NO. 3227, or SEQ ID NO. 8742 or by a mature miRMON18 miRNA derived from a miRMON18 precursor sequence selected from SEQ ID NO. 1763 and SEQ ID NO. 3936) within the natively miRMON18-responsive sequence, and (b) is not recognized by a mature miRMON18 miRNA.

(F) Abiotic-Stress-Responsive miRNA Promoters, Including miRMON18 Promoters.

Also disclosed and claimed is a recombinant DNA construct including a promoter of a miRNA that exhibits an expression pattern characterized by regulation by abiotic stress, for example, a promoter of a miRNA that exhibits an expression pattern characterized by regulation of the miRNA by nutrient stress, a promoter of a miRNA that exhibits an expression pattern characterized by regulation of the miRNA by water stress, or a promoter of a miRNA that exhibits an expression pattern characterized by regulation of the miRNA by temperature stress. Preferred embodiments include a recombinant DNA construct including a promoter of a miRNA that exhibits an expression pattern characterized by regulation of the miRNA by nutrient stress, wherein the nutrient stress comprises at least one nutrient deficiency selected from the group consisting of nitrogen deficiency and phosphate deficiency. In one embodiment, the promoter is that of a miRNA that is suppressed by nitrogen deficiency. In another embodiment, the promoter is that of a miRNA that is suppressed by inorganic phosphate deficiency. In yet another embodiment, the promoter is that of a miRNA that is suppressed by the co-occurrence of nitrogen and phosphate deficiency. In further embodiments, the promoter is that of a miRNA that is upregulated by nitrogen deficiency or by phosphate deficiency.

Particularly preferred embodiments include a recombinant DNA construct including a promoter of a miRNA that exhibits an expression pattern characterized by suppression of the miRNA under nutrient stress, wherein the nutrient stress comprises at least one nutrient deficiency selected from the group consisting of nitrogen deficiency and phosphate deficiency, and wherein the promoter includes at least one of: (a) the promoter of a maize miRNA that exhibits in leaf tissue strong expression under nitrogen-sufficient conditions and suppression under nitrogen-deficient conditions; (b) the promoter of a maize miRNA that exhibits in leaf tissue strong expression under phosphate-sufficient conditions and suppression under phosphate-deficient conditions; (c) a miRMON18 promoter having the sequence of SEQ ID NO. 8804; (d) a fragment of at least about 50 contiguous nucleotides having at least 85% identity to a segment of SEQ ID NO. 8804. Also preferred are embodiments wherein the promoter is operably linked to at least one of: (a) a gene suppression element, and (b) a gene expression element; preferably, these embodiments are useful for expressing the recombinant DNA construct in a plant Non-limiting examples include the promoter having the sequence of nucleotides 211-2172 of SEQ ID NO. 8800; a fragment of at least about 50, at least about 100, at least about 150, at least about 200, at least about 300, at least about 400, or at least 500 contiguous nucleotides having at least 85%, at least 90%, at least 95%, or at least 98% identity to nucleotides 211-2172 of SEQ ID NO. 8800, wherein the fragment has promoter activity in at least one plant tissue that is characterized by strong expression under nitrogen-sufficient conditions and suppression under nitrogen-deficient conditions or strong expression under phosphate-sufficient conditions and suppression under phosphate-deficient conditions; and a fragment of at least about 50, at least about 100, at least about 150, at least about 200, at least about 300, at least about 460, or at least 500 contiguous nucleotides having at least 85%, at least 90%, at least 95%, or at least 98% identity to SEQ ID NO. 8804, wherein the fragment has promoter activity in at least one plant tissue that is characterized by strong expression under nitrogen-sufficient conditions and suppression under nitrogen-deficient conditions or strong expression under phosphate-sufficient conditions and suppression under phosphate-deficient conditions.

(G) Abiotic-Stress-Responsive Transgenic Plant Cells and Plants

Further disclosed and claimed is a non-natural transgenic plant cell including any of the recombinant DNA constructs disclosed under this heading ("Abiotic-Stress-Responsive miRNAs"). One preferred embodiment includes a non-natural transgenic plant prepared from a non-natural transgenic plant cell including a recombinant DNA construct including at least one transcribable DNA element for modulating the expression of at least one target gene, wherein the at least one transcribable DNA element includes a DNA element that transcribes to an miRNA precursor with the fold-back structure of a miRMON18 precursor sequence selected from SEQ ID NO. 1763, SEQ ID NO. 3936, and SEQ ID NO. 8800, wherein the miRNA precursor includes a contiguous segment of at least 90% of the nucleotides of the miRMON18 precursor sequence and is processed to a mature miRMON18 miRNA having the sequence of UUAGAUGACCAUCAG-CAAACA (SEQ ID NO. 393, SEQ ID NO. 3227, or SEQ ID NO. 8742) and the at least one target gene is an endogenous gene of a plant and includes an SPX domain, and wherein expression of the recombinant DNA construct in the plant results in suppression of the at least one target gene; generally the recombinant DNA construct further includes a promoter other than the native miRMON18 promoter to drive expression of the mature miRMON18.

Another preferred embodiment includes a non-natural transgenic plant prepared from a non-natural transgenic plant cell including a recombinant DNA construct including at least one transcribable DNA element for modulating the expression of at least one target gene, wherein the at least one transcribable DNA element includes a DNA element for suppressing expression of an endogenous mature miRMON18 miRNA derived from a miRMON18 precursor sequence selected from SEQ ID NO. 1763, SEQ ID NO. 3936, and SEQ ID NO. 8800, the at least one target gene is an endogenous gene of a plant and includes an SPX domain, and expression of the endogenous gene is suppressed in cells of the plant where native expression of the endogenous mature miRMON18 miRNA occurs, and wherein expression of the recombinant DNA construct in the cells results in expression of the endogenous gene in the cells. Suitable DNA elements for suppressing expression of an endogenous mature miRMON18 miRNA are described above under the heading "Suppression of an endogenous or native miRMON18".

MicroRNA Decoy Sequences

Plant microRNAs regulate their target genes by recognizing and binding to a near-perfectly complementary sequence (miRNA recognition site) in the target transcript, followed by cleavage of the transcript by RNase III enzymes such as Ago1. In plants, certain mismatches between a given miRNA recognition site and the corresponding mature miRNA are not tolerated, particularly mismatched nucleotides at positions 10 and 11 of the mature miRNA. Positions within the mature miRNA are given in the 5' to 3' direction; for clarity, FIG. 7D depicts examples of miRNAs, miR827 (SEQ ID NO. 8744) and miRMON18 (SEQ ID NO. 393, SEQ ID NO. 3227, or SEQ ID NO. 8742), with numbered arrows indicating positions 1, 10, and 21 of the mature miRNA; the nucleotide at position 10 is also underlined. Perfect complementarity between a given miRNA recognition site and the corresponding mature miRNA is usually required at positions 10 and 11 of the mature miRNA. See, for example, Franco-Zorrilla et al. (2007) *Nature Genetics*, 39:1033-1037; and Axtell et al. (2006) *Cell*, 127:565-577.

This characteristic of plant miRNAs was exploited to arrive at rules for predicting a "microRNA decoy sequence", i.e., a sequence that can be recognized and bound by an endogenous mature miRNA resulting in base-pairing between the miRNA decoy sequence and the endogenous mature miRNA, thereby forming a cleavage-resistant RNA duplex that is not cleaved because of the presence of mismatches between the miRNA decoy sequence and the mature miRNA. Mismatches include canonical mismatches (e.g., G-A, C-U, C-A) as well as G::U wobble pairs and indels (nucleotide insertions or deletions). In general, these rules define (1) mismatches that are required, and (2) mismatches that are permitted but not required.

Required mismatches include: (a) at least 1 mismatch between the miRNA decoy sequence and the endogenous mature miRNA at positions 9, 10, or 11 of the endogenous mature miRNA, or alternatively, (b) 1, 2, 3, 4, or 5 insertions (i.e., extra nucleotides) at a position in the miRNA decoy sequence corresponding to positions 9, 10, or 11 of the endogenous mature miRNA. In preferred embodiments, there exists either (a) at least 1 mismatch between the miRNA decoy sequence and the endogenous mature miRNA at positions 10 and/or 11 of the endogenous mature miRNA, or (b) at least 1 insertion at a position in the miRNA decoy sequence corresponding to positions 10 and/or 11 of the endogenous mature miRNA.

Mismatches that are permitted, but not required, include: (a) 0, 1, or 2 mismatches between the miRNA decoy sequence and the endogenous mature miRNA at positions 1, 2, 3, 4, 5, 6, 7, 8, and 9 of the endogenous mature miRNA, and (b) 0, 1, 2, or 3 mismatches between the miRNA decoy sequence and the endogenous mature miRNA at positions 12 through the last position of the endogenous mature miRNA (i.e., at position 21 of a 21-nucleotide mature miRNA), wherein each of the mismatches at positions 12 through the last position of the endogenous mature miRNA is adjacent to at least one complementary base-pair (i.e., so that there is not more than 2 contiguous mismatches at positions 12 through the last position of the endogenous mature miRNA). In preferred embodiments, there exist no mismatches (i.e., there are all complementary base-pairs) at positions 1, 2, 3, 4, 5, 6, 7, and 8 of the endogenous mature miRNA.

The miRNA decoy sequence can be of any length as long as it is recognized and bound by an endogenous mature miRNA to form a cleavage-resistant RNA duplex. In preferred embodiments, the miRNA decoy sequence includes between about 18 to about 36 nucleotides. Specifically claimed embodiments include miRNA decoy sequences of 18, 19, 20, 21, 22, 23, 24, 25, 26, 27, 28, 29, 30, and 31 nucleotides. In non-limiting examples, a miRNA decoy sequence (for a 21-nucleotide mature miRNA) having a required mismatch consisting of a 4-nucleotide insertion at position 10 of the mature miRNA and a permitted mismatch consisting of a 1-nucleotide insertion at position 20 of the mature miRNA has a total of 26 nucleotides; a miRNA decoy sequence (for a 25-nucleotide mature miRNA) having a required mismatch consisting of a 5-nucleotide insertion at position 11 of the mature miRNA and permitted mismatches consisting of a canonical mismatch at position 20 of the mature miRNA and 1-nucleotide insertion at position 23 of the mature miRNA will have a total of 31 nucleotides.

Thus, one embodiment of this invention includes a recombinant DNA construct that is transcribed to an RNA transcript including at least one miRNA decoy sequence that is recognized and bound by an endogenous mature miRNA but not cleaved (e.g., not cleaved by Argonaute or an AGO-like protein), wherein the endogenous miRNA is at least one miRNA selected from (a) mature miRNA selected from a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or (b) a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819; and the miRNA decoy sequence includes an RNA sequence of between about 19 to about 36 contiguous RNA nucleotides, wherein the miRNA decoy sequence is recognized and bound by the endogenous mature miRNA, resulting in base-pairing between the miRNA decoy sequence and the endogenous mature miRNA, thereby forming a cleavage-resistant RNA duplex including: (a) at least one mismatch between said miRNA decoy sequence and said endogenous mature miRNA at positions 9, 10, or 11 of said endogenous mature miRNA, or at least one insertion at a position in said miRNA decoy sequence corresponding to positions 10-11 of said endogenous mature miRNA, (b) 0, 1, or 2 mismatches between said miRNA decoy sequence and said endogenous mature miRNA at positions 1, 2, 3, 4, 5, 6, 7, 8, and 9 of said endogenous mature miRNA, and (c) 0, 1, 2, or 3 mismatches between said miRNA decoy sequence and said endogenous mature miRNA at positions 12 through the last position of said endogenous mature miRNA, wherein each of said mismatches at positions 12 through the last position of said endogenous mature miRNA is adjacent to at least one complementary base-pair.

Recombinant DNA constructs of this invention include at least one miRNA decoy sequence, and can include multiple miRNA decoy sequences (either multiple copies of a single miRNA decoy sequence, or copies of different miRNA decoy sequences, or a combination of both). In one example, multiple copies of a miRNA decoy sequence are arranged in tandem in a recombinant DNA construct designed to decrease the activity of the corresponding mature miRNA. In another example, the activity of different mature miRNAs is decreased by expressing a single chimeric recombinant DNA construct that transcribes to multiple different miRNA decoy sequences. Expression of miRNA decoy sequences can be driven by various promoters, including, but not limited to, tissue-specific, cell-specific, temporally specific, inducible, or constitutive promoters, for example, any of the promoters described under the heading "Promoters". The miRNA decoy sequences can be located in various positions in a transcript. In a recombinant DNA construct that is intended to also transcribe to coding sequence, non-coding sequence (e.g., a miRNA), or both, the miRNA decoy sequence is preferably located in an intron or after the polyadenylation signal, to permit normal transcription of the coding sequence, non-coding sequence, or both.

In further embodiments of this invention, analogous decoy sequences are used to regulate the activity of other small RNAs involved in double-stranded RNA-mediated gene suppression, including trans-acting small interfering RNAs (ta-siRNAs), natural anti-sense transcript siRNAs (nat-siRNAs), and phased small RNAs (as described in U.S. Patent Application 11/897,611, filed 31 Aug. 2007, which is incorporated by reference herein). These analogous ta-siRNA decoy sequences, nat-siRNAs decoy sequences, and phased small RNA decoy sequences are predicted using essentially the same rules as those for predicting miRNA decoy sequences, and have utilities similar to those of the miRNA decoy sequences.

The miRNA decoy sequence can be a naturally-occurring sequence or an artificial sequence. In one embodiment, the at least one miRNA decoy sequence includes a naturally occurring miRNA decoy sequence, for example, an endogenous miRNA decoy sequence identified by bioinformatics. In another embodiment the at least one miRNA decoy sequence includes a synthetic miRNA decoy sequence, for example, one that is designed ab initio to bind to a given mature miRNA to form a cleavage-resistant RNA duplex.

Thus, one embodiment of this invention is a recombinant DNA construct that is transcribed to an RNA transcript including at least one miRMON18 decoy sequence that is recognized and bound by an endogenous mature miRMON18 but not cleaved (e.g., not cleaved by Argonaute or an AGO-like protein), wherein the endogenous miRMON18 is at least one selected from (a) a mature miRMON18, or (b) a mature miRNA derived from a plant miRMON18 precursor sequence; and the miRMON18 decoy sequence includes an RNA sequence of between about 19 to about 36 contiguous RNA nucleotides, wherein the miRMON18 decoy sequence is recognized and bound by the endogenous mature miRMON18, resulting in base-pairing between the miRMON18 decoy sequence and the endogenous mature miRMON18, thereby forming a cleavage-resistant RNA duplex including: (a) at least one mismatch between the miRMON18 decoy sequence and the endogenous mature miRMON18 at positions 9, 10, or 11 of the endogenous mature miRMON18, or at least one insertion at a position in the miRMON18 decoy sequence corresponding to positions 10-11 of the endogenous mature miRMON18, (b) 0, 1, or 2 mismatches between the miRMON18 decoy sequence and the endogenous mature miRMON18 at positions 1, 2, 3, 4, 5, 6, 7, 8, and 9 of the endogenous mature miRMON18, and (c) 0, 1, 2, or 3 mismatches between the miRMON18 decoy sequence and the endogenous mature miRMON18 at positions 12 through the last position of the endogenous mature miRMON18, wherein each of the mismatches at positions 12 through the last position of the endogenous mature miRMON18 is adjacent to at least one complementary base-pair; and wherein the at least one miRMON18 decoy sequence is recognized and bound but not cleaved by a mature miRMON18 miRNA. In preferred embodiments, the mature miRMON18 has the sequence of SEQ ID NO. 393, SEQ ID NO. 3227, or SEQ ID NO. 874, or is a mature miRNA derived from a miRMON18 precursor sequence selected from SEQ ID NO. 1763 and SEQ ID NO. 3936. Further provided by this invention is a method of providing a non-natural transgenic crop plant having improved yield under at least one nutrient deficiency selected from nitrogen deficiency and phosphate deficiency, including expressing in the non-natural transgenic crop plant a recombinant DNA construct that is transcribed to an RNA transcript including at least one miRMON18 decoy sequence.

Another embodiment of this invention is a recombinant DNA construct that is transcribed to an RNA transcript including at least one miR399 decoy sequence that is recognized and bound by an endogenous mature miR399 but not cleaved (e.g., not cleaved by Argonaute or an AGO-like protein), wherein the endogenous miR399 is at least one selected from (a) a mature miR399, or (b) a mature miRNA derived from a miR399 precursor sequence selected from SEQ ID NOS. 8816-8819; and the miR399 decoy sequence includes an RNA sequence of between about 19 to about 36 contiguous RNA nucleotides, wherein the miR399 decoy sequence is recognized and bound by the endogenous mature miR399, resulting in base-pairing between the miR399 decoy sequence and the endogenous mature miR399, thereby forming a cleavage-resistant RNA duplex including: (a) at least one mismatch between the miR399 decoy sequence and the endogenous mature miR399 at positions 9, 10, or 11 of the endogenous mature miR399, or at least one insertion at a position in the miR399 decoy sequence corresponding to positions 10-11 of the endogenous mature miR399, (b) 0, 1, or 2 mismatches between the miR399 decoy sequence and the endogenous mature miR399 at positions 1, 2, 3, 4, 5, 6, 7, 8, and 9 of the endogenous mature miR399, and (c) 0, 1, 2, or 3 mismatches between the miR399 decoy sequence and the endogenous mature miR399 at positions 12 through the last position of the endogenous mature miR399, wherein each of the mismatches at positions 12 through the last position of the endogenous mature miR399 is adjacent to at least one complementary base-pair; and wherein the at least one miR399 decoy sequence is recognized and bound but not cleaved by a mature miR399. In preferred embodiments, the mature miR399 has the sequence of SEQ ID NOS. 8812-8815 or is a mature miRNA derived from a miR399 precursor sequence selected from SEQ ID NOS. 8816-8819. Further provided by this invention is a method of providing a non-natural transgenic crop plant having improved yield under at least one nutrient deficiency selected from nitrogen deficiency and phosphate deficiency, including expressing in the non-natural transgenic crop plant a recombinant DNA construct that is transcribed to an RNA transcript including at least one miR399 decoy sequence.

Yet another embodiment of this invention is suppression of an endogenous miRNA decoy sequence, for example, by means of a gene suppression element (such as those described under the header "DNA element for suppressing expression"), especially driven by a cell- or tissue-specific or an inducible promoter.

Any of these recombinant DNA constructs described herein can be made by commonly used techniques, such as those described under the heading "Making and Using Recombinant DNA Constructs" and illustrated in the working Examples. The recombinant DNA constructs are particularly useful for making non-natural transgenic plant cells, non-natural transgenic plants, and transgenic seeds as discussed below under "Transgenic Plant Cells and Transgenic Plants".

Recombinant DNA constructs including a miRNA decoy sequence are useful for providing unique expression patterns for a synthetic miRNA that is engineered to suppress an endogenous gene; this is especially desirable for preventing adverse phenotypes caused by undesirable expression of the synthetic miRNA in certain tissues. For example, the synthetic miRNA can be used to suppress the endogenous gene only in specific tissues of a plant, e.g., by expression in the plant of a recombinant DNA construct including (a) a constitutive promoter driving expression of the synthetic miRNA, and (b) a tissue-specific promoter driving expression of a miRNA decoy sequence designed to sequester the synthetic miRNA.

Further provided by this invention are methods useful in providing improved crop plants. One aspect of this invention includes a method of providing a non-natural transgenic crop plant having at least one altered trait including expressing in the non-natural transgenic crop plant a recombinant DNA construct that is transcribed to an RNA transcript including at least one miRNA decoy sequence that is recognized and bound by an endogenous mature miRNA but not cleaved (e.g., not cleaved by Argonaute or an AGO-like protein), wherein the endogenous miRNA is at least one miRNA selected from (a) a mature miRNA selected from a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or (b) a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819; and the miRNA decoy sequence includes an RNA sequence of between about 19 to about 36 contiguous RNA nucleotides, wherein the miRNA decoy sequence is recognized and bound by the endogenous mature miRNA, resulting in base-pairing between the miRNA decoy sequence and the endogenous mature miRNA, thereby forming a cleavage-resistant RNA duplex including: (a) at least one mismatch between said miRNA decoy sequence and said endogenous mature miRNA at positions 9, 10, or 11 of said endogenous mature miRNA, or at least one insertion at a position in said miRNA decoy sequence corresponding to positions 10-11 of said endogenous mature miRNA, (b) 0, 1, or 2 mismatches between said miRNA decoy sequence and said endogenous mature miRNA at positions 1, 2, 3, 4, 5, 6, 7, 8, and 9 of said endogenous mature miRNA, and (c) 0, 1, 2, or 3 mismatches between said miRNA decoy sequence and said endogenous mature miRNA at positions 12 through the last position of said endogenous mature miRNA, wherein each of said mismatches at positions 12 through the last position of said endogenous mature miRNA is adjacent to at least one complementary base-pair, thereby resulting in the non-natural transgenic crop plant exhibiting at least one altered trait, relative to a crop plant not expressing the recombinant DNA construct, selected from the group of traits consisting of:

(i) improved abiotic stress tolerance;
    (ii) improved biotic stress tolerance;
    (iii) improved resistance to a pest or pathogen of the plant;
    (iv) modified primary metabolite composition;
    (v) modified secondary metabolite composition;
    (vi) modified trace element, carotenoid, or vitamin composition;
    (vii) improved yield;
    (viii) improved ability to use nitrogen or other nutrients;
    (ix) modified agronomic characteristics;
    (x) modified growth or reproductive characteristics; and
    (xi) improved harvest, storage, or processing quality.

In another aspect, this invention provides a method of providing a non-natural transgenic crop plant having at least one altered trait including suppressing in the non-natural transgenic crop plant at least one endogenous miRNA decoy sequence that is recognized and bound by an endogenous mature miRNA but not cleaved (e.g., not cleaved by Argonaute or an AGO-like protein), wherein the endogenous miRNA is at least one miRNA selected from (a) a mature miRNA selected from a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850, or (b) a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819; and the miRNA decoy sequence includes an RNA sequence of between about 19 to about 36 contiguous RNA nucleotides, wherein the miRNA decoy sequence is recognized and bound by the endogenous mature miRNA, resulting in base-pairing between the miRNA decoy sequence and the endogenous mature miRNA, thereby forming a cleavage-resistant RNA duplex including: (a) at least one mismatch between said miRNA decoy sequence and said endogenous mature miRNA at positions 9, 10, or 11 of said endogenous mature miRNA, or at least one insertion at a position in said miRNA decoy sequence corresponding to positions 10-11 of said endogenous mature miRNA, (b) 0, 1, or 2 mismatches between said miRNA decoy sequence and said endogenous mature miRNA at positions 1, 2, 3, 4, 5, 6, 7, 8, and 9 of said endogenous mature miRNA, and (c) 0, 1, 2, or 3 mismatches between said miRNA decoy sequence and said endogenous mature miRNA at positions 12 through the last position of said endogenous mature miRNA, wherein each of said mismatches at positions 12 through the last position of said endogenous mature miRNA is adjacent to at least one complementary base-pair, thereby resulting in the non-natural transgenic crop plant exhibiting at least one altered trait, relative to a crop plant not expressing the recombinant DNA construct, selected from the group of traits consisting of:

(i) improved abiotic stress tolerance;
(ii) improved biotic stress tolerance;
(iii) improved resistance to a pest or pathogen of the plant;
(iv) modified primary metabolite composition;
(v) modified secondary metabolite composition;
(vi) modified trace element, carotenoid, or vitamin composition;
(vii) improved yield;
(viii) improved ability to use nitrogen or other nutrients;
(ix) modified agronomic characteristics;
(x) modified growth or reproductive characteristics; and
(xi) improved harvest, storage, or processing quality.

Suppression of the at least one endogenous miRNA decoy sequence is achieved by any means, including expression in the non-natural transgenic crop plant a gene suppression element (e.g., such as the DNA elements for suppressing expression described under the heading "Suppression of an endogenous or native miRNA"), or by any other means of gene suppression.

In one non-limiting example, a transgenic plant overexpresses under conditions of nutrient sufficiency at least one miRNA decoy sequence for a miRNA that is natively expressed at high levels under conditions of nutrient sufficiency and at low levels under conditions of nutrient deficiency, thereby resulting in improved performance or yield under nutrient deficiency and improved nutrient utilization by the plant. For example, miRMON18 and miR399 are expressed at low levels during nitrogen- or phosphate-deficient conditions, and at high levels under nitrogen- and phosphate-sufficient conditions, and thus their native target genes are suppressed during nitrogen- or phosphate-deficient conditions and expressed at relatively higher levels under nitrogen- and phosphate-sufficient conditions; this results in improved nitrogen and/or phosphate utilization by the transgenic plant. Thus, a transgenic plant overexpressing a recombinant DNA construct including at least one miRMON18 decoy sequence (or at least one miR399 decoy sequence) results in a higher level of expression of the miRMON18 native target genes (or of the miR399 native target genes) during nitrogen- and phosphate-sufficient conditions, relative to a plant in which the recombinant DNA construct is not expressed. In a non-limiting example, a transgenic plant overexpressing a recombinant DNA construct including at least one miRMON18 decoy sequence is expected to accumulate relatively higher levels of the native miRMON18 targets (e.g., genes containing an SPX domain, such as the genes depicted in FIG. 12, as described in Examples 7, 9, and 10).

EXAMPLES

Example 1

This example describes non-limiting embodiments of methods for identifying crop plant (rice and maize) microRNAs and their precursor (foldback) structures, useful in making recombinant DNA constructs of this invention. Several small (19 to 25 nucleotide) RNA libraries were cloned from mature rice (*Oryza sativa* cv. Nipponbare) mature grain (3 replicates) and seedling and from corn (maize, *Zea mays*) leaf and kernel (39 days after pollination) by high-throughput sequencing (Margulies et al. (2005) *Nature,* 437:376-380). The sequences thus obtained were used for miRNA prediction in rice genomic and maize genomic sequences, respectively, employing a set of rules derived from previously characterized miRNAs, followed by manual inspection to eliminate poorly predicted foldback structures. Small RNAs that matched perfectly to annotated tRNA, rRNA, transposon/retrotransposon and other known repeats, and chloroplast or mitochondria genomes were excluded from the analysis.

The Institute for Genomic Research's rice genome annotation version 4.0 (publicly available at www.tigr.org) was used to predict two flanking genomic segments of 310 nucleotides in which a given small RNA was located near the left or right terminus of the segment (thus giving either a sequence consisting of 280 nucleotides plus the small RNA plus 10 nucleotides, or a sequence consisting of 10 nucleotides plus the small RNA plus 280 nucleotides. The foldback structure of each segment thus obtained was predicted using the RNAfold program in the Vienna package as described by Hofacker et al. (1994) *Monatsh. f Chemie,* 125:167-188. To facilitate the structure prediction, each small RNA was assigned a pseudo-abundance of 2.

The structures were filtered based on characteristics of validated miRNA precursors modified from those derived by Jones-Rhoades et al. (2006) *Annu. Rev. Plant. Biol.,* 57:19-53. For rice miRNAs, the filtering requirements included: (1) the small RNA must be located wholly within one arm of the predicted foldback (stem-loop) structure; (2) the small RNA and its counterpart segment in the opposite arm must have nucleotide sequences of at least 75% complementarity to each other; and (3) the small RNA and its counterpart, when forming the imperfect duplex, must not contain a symmetric bulge larger than 3 nucleotides or an asymmetric bulge larger than 2 nucleotides. The predicted structures satisfying the above criteria were further filtered by selecting (1) only small RNAs of length of 20 or 21 nucleotides and having a uracil as the 5' terminal base; or (2) the small RNA that were sequenced at least 10 times. Final filtering steps included: (1) selecting small RNAs with fewer than 23 perfect matches to the genome to remove repetitive elements, and (2) the segment used for the prediction could not include small RNAs from the minus strand. In cases where multiple overlapping small RNAs were identified, the most abundant member of the cluster was chosen as the representative sequence.

In the case of maize miRNA prediction, the prediction/filtering procedures were modified from those used for the rice miRNAs, since a complete maize genome is not yet available. Small RNAs from the maize leaf and kernel libraries were analyzed independently to facilitate use of small RNA abundances for miRNA prediction. Small RNAs were mapped to Maize Assembled Gene Islands (MAGI version 4), a publicly available, assembled corn genomic sequence dataset as described by Fu et al. (2005), *Proc. Natl. Acad. Sci. USA,* 102:12282-12287. Sequences with small RNAs arising from both plus and minus strands were excluded. MicroRNA foldback structures were predicted and filtered using the same requirements as for rice, and were further manually inspected to eliminate structures with large (>100 nucleotide) or highly unpaired loop regions. Previously characterized miRNAs excluded by filters were used as an indicator of false negatives.

A total of 260676 unique small RNAs from rice in the size range of 19-25 nucleotides were analyzed for putative novel miRNAs. After filtering and manual inspection, 840 small RNAs corresponding to 1072 loci, were identified as novel rice miRNAs. Of the 27 known miRNA families present in the miRNA database "miRBase" (available at microrna.sanger.ac.uk/sequences/) and in the original unique sequence set 22 families were captured after filtering. The false negatives rate of 18.5% percent estimated based on characterized miRNAs (miRBase) indicate that the majority of miRNAs were captured by this approach. From a total of 126691 small RNAs from corn kernel, 116 novel maize miRNAs corresponding to 281 loci in the MAGI version 4.0 corn genomic sequence were identified; similarly, from a total of 53103 small RNAs from corn leaf, 79 novel maize miRNAs corresponding to 302 loci were identified. The rice and maize miRNAs and their corresponding miRNA precursor sequences, as well as the nucleotide position of the mature miRNA in each miRNA precursor sequence, are referred to by their respective sequence identification number in Table 1 as follows: corn kernel miRNAs (SEQ ID NOS. 1-116), corn leaf miRNAs (SEQ ID NOS. 117-195), rice miRNAs (SEQ ID NOS. 196-1035), corn kernel miRNA precursor sequences (SEQ ID NOS. 1036-1316), corn leaf miRNA precursor sequences (SEQ ID NOS. 1317-1618), and rice miRNA precursor sequences (SEQ ID NOS. 1619-2690). The total of 174 predicted novel maize miRNAs (representing 528 genomic loci) included 9 miRNA orthologues that were identical to known miRNAs previously identified in species other than corn; these are listed in Table 2.

TABLE 1

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 1 | 1067 | 11 | 31 |
| 1 | 1236 | 166 | 186 |
| 1 | 1269 | 166 | 186 |
| 2 | 1251 | 172 | 192 |
| 3 | 1115 | 167 | 187 |
| 4 | 1240 | 11 | 31 |
| 5 | 1262 | 100 | 120 |
| 6 | 1074 | 11 | 31 |
| 6 | 1229 | 11 | 31 |
| 6 | 1234 | 11 | 31 |
| 6 | 1235 | 76 | 96 |
| 6 | 1274 | 11 | 31 |
| 6 | 1275 | 11 | 31 |
| 6 | 1276 | 11 | 31 |
| 6 | 1277 | 11 | 31 |
| 6 | 1278 | 11 | 31 |
| 6 | 1279 | 76 | 96 |
| 6 | 1280 | 76 | 96 |
| 6 | 1281 | 11 | 31 |
| 6 | 1282 | 11 | 31 |
| 6 | 1283 | 11 | 31 |
| 6 | 1284 | 11 | 31 |
| 6 | 1285 | 76 | 96 |
| 6 | 1286 | 11 | 31 |
| 6 | 1287 | 11 | 31 |
| 6 | 1288 | 11 | 31 |
| 6 | 1289 | 11 | 31 |
| 7 | 1205 | 70 | 90 |
| 7 | 1221 | 116 | 136 |
| 8 | 1041 | 11 | 31 |
| 8 | 1196 | 78 | 98 |
| 9 | 1110 | 92 | 113 |
| 9 | 1182 | 79 | 100 |
| 9 | 1255 | 11 | 32 |
| 10 | 1106 | 64 | 84 |
| 11 | 1194 | 64 | 84 |
| 12 | 1048 | 74 | 94 |
| 12 | 1257 | 11 | 31 |
| 12 | 1266 | 74 | 94 |
| 12 | 1267 | 74 | 94 |
| 13 | 1059 | 72 | 92 |
| 13 | 1068 | 11 | 31 |
| 13 | 1237 | 11 | 31 |
| 14 | 1226 | 11 | 31 |
| 14 | 1249 | 69 | 89 |
| 15 | 1066 | 11 | 31 |
| 15 | 1233 | 11 | 31 |
| 15 | 1256 | 11 | 31 |
| 15 | 1260 | 11 | 31 |
| 15 | 1265 | 115 | 135 |
| 15 | 1308 | 11 | 31 |
| 16 | 1129 | 128 | 146 |
| 16 | 1199 | 11 | 29 |
| 17 | 1040 | 45 | 68 |
| 17 | 1246 | 11 | 34 |
| 17 | 1247 | 45 | 68 |
| 18 | 1131 | 104 | 127 |
| 19 | 1119 | 142 | 162 |
| 19 | 1166 | 11 | 31 |
| 19 | 1169 | 143 | 163 |
| 19 | 1172 | 69 | 89 |
| 19 | 1175 | 11 | 31 |
| 19 | 1177 | 143 | 163 |
| 19 | 1180 | 11 | 31 |
| 19 | 1186 | 11 | 31 |
| 20 | 1087 | 230 | 251 |
| 20 | 1258 | 11 | 32 |
| 21 | 1046 | 11 | 31 |
| 21 | 1157 | 63 | 83 |
| 21 | 1216 | 73 | 93 |
| 22 | 1254 | 102 | 122 |
| 23 | 1261 | 11 | 30 |
| 24 | 1125 | 70 | 90 |
| 24 | 1314 | 11 | 31 |
| 24 | 1315 | 11 | 31 |
| 25 | 1161 | 11 | 31 |
| 26 | 1124 | 11 | 31 |
| 27 | 1198 | 77 | 96 |
| 28 | 1309 | 74 | 94 |
| 29 | 1114 | 11 | 29 |
| 29 | 1232 | 11 | 29 |
| 30 | 1192 | 70 | 91 |
| 31 | 1077 | 72 | 92 |
| 32 | 1136 | 88 | 108 |
| 33 | 1054 | 38 | 58 |
| 34 | 1053 | 11 | 31 |
| 34 | 1096 | 11 | 31 |
| 34 | 1292 | 84 | 104 |
| 34 | 1307 | 84 | 104 |
| 34 | 1313 | 85 | 105 |
| 35 | 1063 | 11 | 31 |
| 35 | 1214 | 11 | 31 |
| 36 | 1156 | 11 | 31 |
| 37 | 1055 | 11 | 30 |
| 38 | 1291 | 83 | 103 |
| 39 | 1116 | 11 | 31 |
| 39 | 1138 | 11 | 31 |
| 40 | 1201 | 82 | 102 |
| 41 | 1065 | 65 | 85 |
| 41 | 1070 | 11 | 31 |
| 41 | 1088 | 65 | 85 |
| 41 | 1113 | 11 | 31 |
| 41 | 1154 | 11 | 31 |
| 41 | 1163 | 11 | 31 |
| 41 | 1173 | 63 | 83 |
| 42 | 1310 | 11 | 31 |
| 43 | 1122 | 105 | 125 |
| 44 | 1159 | 86 | 106 |
| 45 | 1081 | 11 | 31 |
| 46 | 1104 | 11 | 31 |
| 47 | 1108 | 11 | 31 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 48 | 1057 | 11 | 31 |
| 48 | 1162 | 185 | 205 |
| 49 | 1112 | 127 | 147 |
| 49 | 1130 | 11 | 31 |
| 49 | 1144 | 11 | 31 |
| 49 | 1145 | 11 | 31 |
| 49 | 1168 | 11 | 31 |
| 49 | 1195 | 115 | 135 |
| 49 | 1211 | 122 | 142 |
| 49 | 1215 | 11 | 31 |
| 49 | 1217 | 127 | 147 |
| 49 | 1219 | 11 | 31 |
| 50 | 1056 | 11 | 30 |
| 51 | 1036 | 60 | 80 |
| 51 | 1089 | 11 | 31 |
| 52 | 1143 | 64 | 84 |
| 53 | 1060 | 36 | 56 |
| 54 | 1058 | 206 | 226 |
| 54 | 1064 | 199 | 219 |
| 54 | 1128 | 199 | 219 |
| 54 | 1224 | 197 | 217 |
| 54 | 1242 | 200 | 220 |
| 54 | 1272 | 11 | 31 |
| 54 | 1312 | 11 | 31 |
| 55 | 1141 | 70 | 90 |
| 56 | 1061 | 11 | 30 |
| 57 | 1183 | 114 | 134 |
| 58 | 1140 | 132 | 152 |
| 59 | 1126 | 11 | 31 |
| 60 | 1181 | 11 | 31 |
| 61 | 1204 | 47 | 67 |
| 62 | 1037 | 89 | 109 |
| 62 | 1071 | 11 | 31 |
| 62 | 1146 | 11 | 31 |
| 62 | 1148 | 11 | 31 |
| 62 | 1270 | 11 | 31 |
| 63 | 1227 | 11 | 31 |
| 63 | 1231 | 11 | 31 |
| 63 | 1243 | 11 | 31 |
| 63 | 1295 | 151 | 171 |
| 63 | 1296 | 151 | 171 |
| 63 | 1297 | 151 | 171 |
| 63 | 1298 | 151 | 171 |
| 63 | 1299 | 11 | 31 |
| 63 | 1300 | 11 | 31 |
| 63 | 1301 | 151 | 171 |
| 63 | 1302 | 11 | 31 |
| 63 | 1303 | 11 | 31 |
| 63 | 1304 | 152 | 172 |
| 63 | 1305 | 11 | 31 |
| 64 | 1038 | 101 | 120 |
| 64 | 1084 | 11 | 30 |
| 64 | 1127 | 11 | 30 |
| 64 | 1133 | 11 | 30 |
| 64 | 1147 | 101 | 120 |
| 64 | 1160 | 11 | 30 |
| 64 | 1170 | 183 | 202 |
| 64 | 1171 | 11 | 30 |
| 64 | 1185 | 11 | 30 |
| 64 | 1190 | 11 | 30 |
| 64 | 1193 | 11 | 30 |
| 64 | 1206 | 11 | 30 |
| 64 | 1208 | 11 | 30 |
| 64 | 1244 | 11 | 30 |
| 64 | 1245 | 11 | 30 |
| 64 | 1253 | 11 | 30 |
| 64 | 1259 | 11 | 30 |
| 64 | 1268 | 183 | 202 |
| 65 | 1098 | 241 | 261 |
| 65 | 1189 | 241 | 261 |
| 66 | 1045 | 11 | 31 |
| 66 | 1252 | 133 | 153 |
| 67 | 1094 | 71 | 91 |
| 68 | 1152 | 11 | 31 |
| 68 | 1158 | 11 | 31 |
| 68 | 1203 | 11 | 31 |
| 69 | 1097 | 43 | 63 |
| 70 | 1103 | 11 | 31 |
| 71 | 1239 | 41 | 61 |
| 72 | 1044 | 11 | 31 |
| 73 | 1271 | 44 | 64 |
| 74 | 1042 | 76 | 96 |
| 75 | 1230 | 11 | 31 |
| 76 | 1149 | 11 | 31 |
| 77 | 1218 | 11 | 30 |
| 78 | 1073 | 141 | 161 |
| 79 | 1047 | 11 | 31 |
| 80 | 1293 | 82 | 101 |
| 81 | 1080 | 11 | 31 |
| 82 | 1316 | 11 | 31 |
| 83 | 1118 | 11 | 31 |
| 84 | 1050 | 11 | 31 |
| 85 | 1072 | 115 | 135 |
| 86 | 1085 | 31 | 51 |
| 86 | 1241 | 31 | 51 |
| 87 | 1187 | 11 | 31 |
| 87 | 1197 | 11 | 31 |
| 87 | 1207 | 39 | 59 |
| 87 | 1213 | 38 | 58 |
| 88 | 1117 | 91 | 111 |
| 89 | 1101 | 47 | 67 |
| 90 | 1174 | 155 | 174 |
| 91 | 1209 | 149 | 169 |
| 91 | 1273 | 149 | 169 |
| 92 | 1039 | 11 | 31 |
| 92 | 1228 | 55 | 75 |
| 92 | 1238 | 55 | 75 |
| 92 | 1250 | 55 | 75 |
| 93 | 1099 | 11 | 30 |
| 94 | 1132 | 145 | 165 |
| 94 | 1139 | 140 | 160 |
| 94 | 1167 | 11 | 31 |
| 95 | 1052 | 11 | 31 |
| 96 | 1049 | 11 | 30 |
| 96 | 1105 | 11 | 30 |
| 97 | 1051 | 66 | 85 |
| 97 | 1100 | 136 | 155 |
| 98 | 1164 | 11 | 31 |
| 99 | 1086 | 73 | 93 |
| 99 | 1093 | 11 | 31 |
| 99 | 1294 | 70 | 90 |
| 100 | 1109 | 83 | 103 |
| 100 | 1111 | 11 | 31 |
| 100 | 1137 | 11 | 31 |
| 100 | 1151 | 11 | 31 |
| 100 | 1179 | 36 | 56 |
| 100 | 1184 | 11 | 31 |
| 100 | 1210 | 11 | 31 |
| 100 | 1222 | 72 | 92 |
| 101 | 1043 | 35 | 55 |
| 102 | 1311 | 67 | 87 |
| 103 | 1082 | 11 | 31 |
| 103 | 1120 | 11 | 31 |
| 103 | 1165 | 147 | 167 |
| 103 | 1178 | 147 | 167 |
| 103 | 1220 | 11 | 31 |
| 104 | 1076 | 131 | 151 |
| 104 | 1083 | 131 | 151 |
| 105 | 1102 | 11 | 31 |
| 105 | 1212 | 11 | 31 |
| 105 | 1225 | 11 | 31 |
| 106 | 1306 | 11 | 31 |
| 107 | 1062 | 11 | 30 |
| 107 | 1075 | 11 | 30 |
| 107 | 1091 | 75 | 94 |
| 107 | 1121 | 11 | 30 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 107 | 1134 | 11 | 30 |
| 107 | 1142 | 11 | 30 |
| 107 | 1176 | 75 | 94 |
| 107 | 1191 | 76 | 95 |
| 107 | 1200 | 76 | 95 |
| 107 | 1248 | 73 | 92 |
| 107 | 1263 | 76 | 95 |
| 108 | 1078 | 11 | 31 |
| 109 | 1135 | 75 | 95 |
| 110 | 1153 | 11 | 31 |
| 111 | 1150 | 110 | 130 |
| 112 | 1123 | 11 | 30 |
| 113 | 1202 | 73 | 93 |
| 114 | 1223 | 144 | 164 |
| 115 | 1069 | 11 | 31 |
| 115 | 1079 | 11 | 31 |
| 115 | 1092 | 11 | 31 |
| 115 | 1290 | 11 | 31 |
| 116 | 1090 | 11 | 31 |
| 116 | 1095 | 182 | 202 |
| 116 | 1107 | 11 | 31 |
| 116 | 1155 | 193 | 213 |
| 116 | 1188 | 198 | 218 |
| 116 | 1264 | 199 | 219 |
| 117 | 1366 | 11 | 31 |
| 117 | 1538 | 166 | 186 |
| 117 | 1578 | 166 | 186 |
| 118 | 1557 | 172 | 192 |
| 119 | 1397 | 167 | 187 |
| 120 | 1449 | 213 | 233 |
| 120 | 1540 | 11 | 31 |
| 121 | 1572 | 100 | 120 |
| 122 | 1507 | 189 | 208 |
| 123 | 1369 | 11 | 31 |
| 123 | 1534 | 11 | 31 |
| 123 | 1536 | 11 | 31 |
| 123 | 1537 | 76 | 96 |
| 123 | 1583 | 11 | 31 |
| 123 | 1584 | 11 | 31 |
| 123 | 1585 | 11 | 31 |
| 123 | 1586 | 11 | 31 |
| 123 | 1587 | 11 | 31 |
| 123 | 1588 | 11 | 31 |
| 123 | 1589 | 76 | 96 |
| 123 | 1590 | 76 | 96 |
| 123 | 1591 | 11 | 31 |
| 123 | 1592 | 11 | 31 |
| 123 | 1593 | 11 | 31 |
| 123 | 1594 | 11 | 31 |
| 123 | 1595 | 76 | 96 |
| 123 | 1596 | 11 | 31 |
| 123 | 1597 | 11 | 31 |
| 123 | 1598 | 11 | 31 |
| 123 | 1599 | 11 | 31 |
| 124 | 1505 | 70 | 90 |
| 124 | 1522 | 116 | 136 |
| 125 | 1324 | 11 | 31 |
| 125 | 1484 | 78 | 98 |
| 126 | 1466 | 79 | 100 |
| 126 | 1560 | 11 | 32 |
| 127 | 1389 | 64 | 84 |
| 127 | 1401 | 11 | 31 |
| 128 | 1482 | 64 | 84 |
| 129 | 1337 | 74 | 94 |
| 129 | 1565 | 11 | 31 |
| 129 | 1576 | 74 | 94 |
| 129 | 1577 | 74 | 94 |
| 130 | 1559 | 11 | 31 |
| 131 | 1532 | 11 | 31 |
| 131 | 1554 | 69 | 89 |
| 132 | 1365 | 11 | 31 |
| 132 | 1535 | 11 | 31 |
| 132 | 1562 | 11 | 31 |
| 132 | 1568 | 11 | 31 |
| 132 | 1575 | 115 | 135 |
| 132 | 1612 | 11 | 31 |
| 133 | 1451 | 156 | 176 |
| 133 | 1519 | 107 | 127 |
| 134 | 1413 | 128 | 146 |
| 134 | 1500 | 11 | 29 |
| 135 | 1406 | 232 | 252 |
| 136 | 1489 | 80 | 102 |
| 137 | 1543 | 11 | 31 |
| 138 | 1558 | 102 | 122 |
| 139 | 1549 | 56 | 75 |
| 140 | 1571 | 11 | 30 |
| 141 | 1462 | 11 | 31 |
| 142 | 1514 | 11 | 31 |
| 143 | 1613 | 74 | 94 |
| 144 | 1611 | 68 | 88 |
| 145 | 1418 | 11 | 31 |
| 145 | 1459 | 11 | 31 |
| 145 | 1460 | 11 | 31 |
| 146 | 1479 | 70 | 91 |
| 147 | 1320 | 11 | 31 |
| 147 | 1380 | 11 | 31 |
| 147 | 1381 | 11 | 31 |
| 147 | 1382 | 11 | 31 |
| 147 | 1383 | 11 | 31 |
| 147 | 1384 | 11 | 31 |
| 147 | 1385 | 11 | 31 |
| 147 | 1409 | 97 | 117 |
| 147 | 1411 | 100 | 120 |
| 147 | 1417 | 102 | 122 |
| 147 | 1422 | 11 | 31 |
| 147 | 1456 | 11 | 31 |
| 147 | 1483 | 11 | 31 |
| 147 | 1493 | 100 | 120 |
| 147 | 1502 | 11 | 31 |
| 147 | 1517 | 100 | 120 |
| 147 | 1545 | 11 | 31 |
| 147 | 1550 | 11 | 31 |
| 147 | 1561 | 11 | 31 |
| 147 | 1564 | 11 | 31 |
| 147 | 1566 | 11 | 31 |
| 147 | 1569 | 11 | 31 |
| 148 | 1372 | 72 | 92 |
| 149 | 1424 | 74 | 95 |
| 149 | 1616 | 11 | 32 |
| 150 | 1457 | 152 | 175 |
| 150 | 1513 | 152 | 175 |
| 150 | 1515 | 152 | 175 |
| 151 | 1398 | 11 | 31 |
| 151 | 1442 | 11 | 31 |
| 151 | 1469 | 11 | 31 |
| 151 | 1506 | 11 | 31 |
| 151 | 1520 | 191 | 211 |
| 151 | 1551 | 190 | 210 |
| 151 | 1581 | 192 | 212 |
| 152 | 1504 | 99 | 119 |
| 153 | 1503 | 82 | 102 |
| 154 | 1410 | 38 | 58 |
| 155 | 1487 | 200 | 220 |
| 156 | 1386 | 11 | 31 |
| 156 | 1396 | 43 | 63 |
| 156 | 1546 | 11 | 31 |
| 156 | 1563 | 11 | 31 |
| 156 | 1601 | 11 | 31 |
| 157 | 1360 | 91 | 110 |
| 157 | 1400 | 95 | 114 |
| 157 | 1415 | 95 | 114 |
| 157 | 1425 | 11 | 30 |
| 157 | 1426 | 92 | 111 |
| 157 | 1453 | 11 | 30 |
| 157 | 1474 | 127 | 146 |
| 157 | 1480 | 56 | 75 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 157 | 1527 | 91 | 110 |
| 157 | 1552 | 11 | 30 |
| 157 | 1570 | 57 | 76 |
| 157 | 1618 | 58 | 77 |
| 158 | 1394 | 11 | 31 |
| 159 | 1421 | 11 | 30 |
| 159 | 1450 | 207 | 226 |
| 159 | 1495 | 11 | 30 |
| 160 | 1423 | 202 | 222 |
| 160 | 1529 | 11 | 31 |
| 160 | 1533 | 199 | 219 |
| 161 | 1447 | 11 | 31 |
| 161 | 1555 | 11 | 31 |
| 162 | 1336 | 11 | 30 |
| 162 | 1579 | 11 | 30 |
| 163 | 1454 | 133 | 153 |
| 164 | 1553 | 11 | 31 |
| 165 | 1343 | 11 | 31 |
| 165 | 1353 | 11 | 31 |
| 165 | 1468 | 168 | 188 |
| 165 | 1475 | 113 | 133 |
| 165 | 1512 | 113 | 133 |
| 165 | 1547 | 107 | 127 |
| 166 | 1432 | 128 | 148 |
| 166 | 1548 | 128 | 148 |
| 167 | 1350 | 11 | 30 |
| 168 | 1405 | 72 | 91 |
| 169 | 1429 | 38 | 58 |
| 170 | 1376 | 198 | 218 |
| 170 | 1416 | 11 | 31 |
| 170 | 1440 | 11 | 31 |
| 170 | 1465 | 199 | 219 |
| 170 | 1614 | 11 | 31 |
| 171 | 1420 | 138 | 158 |
| 172 | 1317 | 67 | 87 |
| 172 | 1326 | 67 | 87 |
| 172 | 1333 | 67 | 87 |
| 172 | 1338 | 67 | 87 |
| 172 | 1339 | 68 | 88 |
| 172 | 1340 | 67 | 87 |
| 172 | 1341 | 67 | 87 |
| 172 | 1344 | 67 | 87 |
| 172 | 1346 | 68 | 88 |
| 172 | 1348 | 67 | 87 |
| 172 | 1352 | 67 | 87 |
| 172 | 1431 | 68 | 88 |
| 172 | 1437 | 67 | 87 |
| 172 | 1448 | 67 | 87 |
| 172 | 1458 | 68 | 88 |
| 172 | 1477 | 68 | 88 |
| 173 | 1582 | 36 | 56 |
| 174 | 1322 | 136 | 156 |
| 174 | 1330 | 9 | 29 |
| 174 | 1349 | 11 | 31 |
| 174 | 1355 | 136 | 156 |
| 174 | 1399 | 137 | 157 |
| 174 | 1491 | 136 | 156 |
| 174 | 1508 | 136 | 156 |
| 174 | 1509 | 11 | 31 |
| 175 | 1615 | 11 | 31 |
| 176 | 1392 | 117 | 136 |
| 176 | 1438 | 43 | 62 |
| 176 | 1464 | 11 | 30 |
| 176 | 1490 | 11 | 30 |
| 176 | 1492 | 43 | 62 |
| 176 | 1498 | 11 | 30 |
| 176 | 1499 | 43 | 62 |
| 176 | 1510 | 11 | 30 |
| 177 | 1371 | 11 | 31 |
| 178 | 1358 | 75 | 95 |
| 178 | 1364 | 59 | 79 |
| 178 | 1390 | 11 | 31 |
| 178 | 1393 | 75 | 95 |
| 178 | 1395 | 11 | 31 |
| 178 | 1408 | 71 | 91 |
| 178 | 1428 | 57 | 77 |
| 178 | 1434 | 11 | 31 |
| 178 | 1436 | 75 | 95 |
| 178 | 1443 | 75 | 95 |
| 178 | 1455 | 56 | 76 |
| 178 | 1461 | 75 | 95 |
| 178 | 1463 | 75 | 95 |
| 178 | 1467 | 75 | 95 |
| 178 | 1470 | 75 | 95 |
| 178 | 1476 | 11 | 31 |
| 178 | 1485 | 11 | 31 |
| 178 | 1488 | 11 | 31 |
| 178 | 1496 | 11 | 31 |
| 178 | 1516 | 11 | 31 |
| 178 | 1518 | 11 | 31 |
| 178 | 1523 | 75 | 95 |
| 178 | 1525 | 75 | 95 |
| 178 | 1528 | 11 | 31 |
| 178 | 1531 | 10 | 30 |
| 178 | 1542 | 11 | 31 |
| 178 | 1544 | 11 | 31 |
| 178 | 1556 | 11 | 31 |
| 178 | 1567 | 11 | 31 |
| 178 | 1573 | 11 | 31 |
| 178 | 1574 | 75 | 95 |
| 179 | 1435 | 55 | 75 |
| 180 | 1402 | 113 | 133 |
| 180 | 1441 | 11 | 31 |
| 180 | 1521 | 103 | 123 |
| 180 | 1617 | 105 | 125 |
| 181 | 1329 | 33 | 53 |
| 182 | 1334 | 11 | 31 |
| 182 | 1345 | 211 | 231 |
| 182 | 1347 | 11 | 31 |
| 183 | 1452 | 36 | 56 |
| 184 | 1407 | 144 | 164 |
| 185 | 1404 | 11 | 31 |
| 185 | 1412 | 11 | 31 |
| 185 | 1419 | 11 | 31 |
| 185 | 1481 | 11 | 31 |
| 185 | 1494 | 11 | 31 |
| 185 | 1524 | 11 | 31 |
| 185 | 1526 | 11 | 31 |
| 186 | 1478 | 11 | 31 |
| 186 | 1511 | 11 | 31 |
| 186 | 1539 | 11 | 31 |
| 187 | 1430 | 112 | 132 |
| 187 | 1439 | 241 | 261 |
| 188 | 1342 | 11 | 31 |
| 188 | 1541 | 11 | 31 |
| 189 | 1367 | 11 | 31 |
| 189 | 1391 | 63 | 83 |
| 189 | 1414 | 11 | 31 |
| 189 | 1427 | 11 | 31 |
| 189 | 1530 | 11 | 31 |
| 189 | 1602 | 11 | 31 |
| 189 | 1603 | 11 | 31 |
| 189 | 1604 | 11 | 31 |
| 189 | 1605 | 10 | 30 |
| 189 | 1606 | 11 | 31 |
| 189 | 1607 | 11 | 31 |
| 189 | 1608 | 11 | 31 |
| 189 | 1609 | 11 | 31 |
| 189 | 1610 | 11 | 31 |
| 190 | 1403 | 11 | 31 |
| 190 | 1471 | 11 | 31 |
| 190 | 1497 | 11 | 31 |
| 191 | 1318 | 72 | 92 |
| 191 | 1319 | 72 | 92 |
| 191 | 1321 | 11 | 31 |
| 191 | 1325 | 11 | 31 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 191 | 1327 | 11 | 31 |
| 191 | 1328 | 11 | 31 |
| 191 | 1331 | 72 | 92 |
| 191 | 1332 | 72 | 92 |
| 191 | 1335 | 72 | 92 |
| 191 | 1351 | 11 | 31 |
| 191 | 1357 | 11 | 31 |
| 191 | 1359 | 75 | 95 |
| 191 | 1361 | 72 | 92 |
| 191 | 1362 | 11 | 31 |
| 191 | 1363 | 72 | 92 |
| 191 | 1368 | 11 | 31 |
| 191 | 1370 | 72 | 92 |
| 191 | 1373 | 72 | 92 |
| 191 | 1374 | 72 | 92 |
| 191 | 1375 | 11 | 31 |
| 191 | 1377 | 11 | 31 |
| 191 | 1378 | 72 | 92 |
| 191 | 1379 | 72 | 92 |
| 192 | 1356 | 11 | 31 |
| 193 | 1323 | 77 | 97 |
| 193 | 1354 | 11 | 31 |
| 193 | 1387 | 11 | 31 |
| 193 | 1388 | 11 | 31 |
| 193 | 1433 | 112 | 132 |
| 193 | 1444 | 11 | 31 |
| 193 | 1445 | 11 | 31 |
| 193 | 1446 | 11 | 31 |
| 193 | 1473 | 77 | 97 |
| 193 | 1486 | 11 | 31 |
| 193 | 1501 | 11 | 31 |
| 193 | 1580 | 75 | 95 |
| 194 | 1472 | 33 | 53 |
| 195 | 1600 | 63 | 83 |
| 196 | 1663 | 281 | 299 |
| 197 | 2542 | 11 | 31 |
| 198 | 2532 | 11 | 31 |
| 199 | 1977 | 66 | 86 |
| 200 | 1946 | 11 | 30 |
| 201 | 2365 | 11 | 31 |
| 202 | 1735 | 34 | 53 |
| 203 | 2046 | 64 | 84 |
| 204 | 1746 | 281 | 301 |
| 205 | 1778 | 11 | 31 |
| 206 | 2189 | 45 | 64 |
| 207 | 2549 | 11 | 31 |
| 208 | 2597 | 11 | 31 |
| 209 | 2519 | 195 | 214 |
| 210 | 1829 | 257 | 277 |
| 211 | 2291 | 241 | 260 |
| 212 | 1938 | 11 | 30 |
| 212 | 1994 | 11 | 30 |
| 213 | 2056 | 144 | 164 |
| 213 | 2265 | 137 | 157 |
| 214 | 1950 | 264 | 283 |
| 214 | 2039 | 225 | 244 |
| 214 | 2148 | 225 | 244 |
| 214 | 2358 | 225 | 244 |
| 214 | 2491 | 209 | 228 |
| 215 | 2116 | 194 | 213 |
| 216 | 2273 | 258 | 278 |
| 217 | 1631 | 252 | 270 |
| 218 | 1679 | 11 | 31 |
| 219 | 2304 | 11 | 30 |
| 220 | 2071 | 85 | 105 |
| 221 | 1813 | 281 | 301 |
| 222 | 2604 | 201 | 220 |
| 223 | 2054 | 11 | 30 |
| 224 | 2653 | 124 | 147 |
| 225 | 1761 | 134 | 153 |
| 226 | 2554 | 11 | 29 |
| 227 | 1713 | 259 | 277 |
| 228 | 2557 | 11 | 31 |
| 229 | 1860 | 11 | 31 |
| 229 | 1922 | 41 | 61 |
| 230 | 2582 | 11 | 31 |
| 231 | 2309 | 104 | 122 |
| 232 | 1913 | 11 | 31 |
| 233 | 1747 | 11 | 31 |
| 234 | 1644 | 11 | 30 |
| 235 | 2174 | 11 | 31 |
| 236 | 2017 | 100 | 120 |
| 236 | 2120 | 98 | 118 |
| 237 | 2010 | 113 | 132 |
| 238 | 2528 | 11 | 31 |
| 239 | 2417 | 11 | 30 |
| 240 | 1802 | 112 | 130 |
| 240 | 2299 | 200 | 218 |
| 240 | 2591 | 243 | 261 |
| 240 | 2592 | 11 | 29 |
| 241 | 1643 | 11 | 30 |
| 241 | 2122 | 11 | 30 |
| 241 | 2280 | 11 | 30 |
| 242 | 2489 | 11 | 30 |
| 243 | 2074 | 274 | 294 |
| 244 | 1890 | 266 | 285 |
| 245 | 2139 | 193 | 216 |
| 246 | 1892 | 80 | 100 |
| 247 | 1861 | 55 | 77 |
| 248 | 2676 | 11 | 30 |
| 249 | 2681 | 272 | 291 |
| 249 | 2682 | 11 | 30 |
| 250 | 2005 | 73 | 93 |
| 250 | 2092 | 73 | 93 |
| 250 | 2406 | 52 | 72 |
| 251 | 2202 | 11 | 29 |
| 252 | 1919 | 239 | 258 |
| 253 | 2409 | 248 | 271 |
| 254 | 1926 | 11 | 31 |
| 255 | 2445 | 247 | 267 |
| 256 | 1804 | 11 | 31 |
| 257 | 1774 | 149 | 168 |
| 258 | 2394 | 11 | 31 |
| 259 | 1697 | 87 | 107 |
| 260 | 2268 | 37 | 55 |
| 261 | 2063 | 281 | 304 |
| 262 | 1686 | 11 | 31 |
| 263 | 2184 | 11 | 31 |
| 264 | 2158 | 48 | 67 |
| 264 | 2399 | 217 | 236 |
| 265 | 2353 | 11 | 34 |
| 266 | 2524 | 11 | 31 |
| 267 | 2183 | 11 | 30 |
| 268 | 2140 | 146 | 169 |
| 269 | 2038 | 11 | 31 |
| 270 | 2257 | 54 | 74 |
| 271 | 2389 | 112 | 131 |
| 272 | 2522 | 256 | 275 |
| 273 | 2422 | 37 | 56 |
| 274 | 1969 | 11 | 29 |
| 275 | 2481 | 228 | 248 |
| 276 | 2080 | 92 | 112 |
| 277 | 2261 | 59 | 78 |
| 278 | 2368 | 166 | 188 |
| 279 | 1627 | 11 | 30 |
| 280 | 2006 | 11 | 31 |
| 281 | 2431 | 11 | 30 |
| 282 | 2200 | 228 | 248 |
| 283 | 2081 | 38 | 58 |
| 284 | 1902 | 11 | 31 |
| 285 | 2343 | 11 | 31 |
| 286 | 1887 | 233 | 253 |
| 287 | 2393 | 139 | 159 |
| 288 | 2262 | 47 | 67 |
| 289 | 2137 | 71 | 91 |
| 290 | 2684 | 11 | 31 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 291 | 1771 | 30 | 49 |
| 292 | 1807 | 238 | 256 |
| 292 | 1954 | 11 | 29 |
| 293 | 2103 | 11 | 30 |
| 294 | 2656 | 11 | 31 |
| 295 | 2488 | 11 | 30 |
| 296 | 1848 | 63 | 83 |
| 297 | 2514 | 37 | 57 |
| 298 | 1845 | 11 | 31 |
| 299 | 2157 | 11 | 30 |
| 300 | 2415 | 69 | 89 |
| 301 | 2520 | 278 | 298 |
| 302 | 2584 | 11 | 31 |
| 303 | 2474 | 11 | 30 |
| 304 | 2536 | 32 | 51 |
| 305 | 1728 | 281 | 301 |
| 306 | 2228 | 11 | 31 |
| 306 | 2240 | 11 | 31 |
| 307 | 2483 | 11 | 30 |
| 308 | 1784 | 11 | 29 |
| 309 | 1847 | 125 | 145 |
| 310 | 1872 | 42 | 61 |
| 311 | 1759 | 11 | 34 |
| 311 | 1999 | 11 | 34 |
| 311 | 2223 | 11 | 34 |
| 311 | 2543 | 11 | 34 |
| 312 | 2232 | 141 | 160 |
| 313 | 1658 | 103 | 122 |
| 313 | 2107 | 146 | 165 |
| 314 | 2581 | 11 | 31 |
| 315 | 2471 | 11 | 31 |
| 316 | 2106 | 72 | 92 |
| 317 | 2043 | 66 | 86 |
| 318 | 1963 | 200 | 219 |
| 319 | 2121 | 11 | 30 |
| 319 | 2373 | 11 | 30 |
| 319 | 2475 | 11 | 30 |
| 319 | 2566 | 96 | 115 |
| 320 | 1685 | 11 | 31 |
| 321 | 2464 | 11 | 31 |
| 322 | 1822 | 39 | 57 |
| 323 | 1858 | 11 | 31 |
| 324 | 2003 | 40 | 60 |
| 325 | 2531 | 35 | 54 |
| 326 | 1827 | 11 | 30 |
| 327 | 2465 | 11 | 30 |
| 328 | 1973 | 11 | 30 |
| 329 | 2279 | 262 | 281 |
| 330 | 1857 | 62 | 81 |
| 331 | 2527 | 11 | 31 |
| 332 | 1755 | 46 | 66 |
| 333 | 1850 | 11 | 31 |
| 333 | 2145 | 11 | 31 |
| 333 | 2296 | 11 | 31 |
| 333 | 2400 | 11 | 31 |
| 333 | 2636 | 11 | 31 |
| 334 | 1951 | 11 | 31 |
| 335 | 2510 | 36 | 55 |
| 336 | 1700 | 11 | 31 |
| 336 | 2622 | 11 | 31 |
| 337 | 2446 | 242 | 262 |
| 338 | 2082 | 11 | 32 |
| 339 | 2301 | 11 | 31 |
| 340 | 1721 | 11 | 30 |
| 341 | 1876 | 11 | 31 |
| 342 | 2659 | 11 | 30 |
| 343 | 1937 | 11 | 31 |
| 344 | 1864 | 11 | 30 |
| 345 | 1869 | 128 | 148 |
| 346 | 1692 | 11 | 30 |
| 347 | 2276 | 277 | 297 |
| 348 | 2141 | 11 | 29 |
| 349 | 2023 | 11 | 31 |
| 350 | 2219 | 11 | 31 |
| 351 | 2472 | 176 | 196 |
| 352 | 1724 | 11 | 31 |
| 353 | 1955 | 11 | 30 |
| 354 | 2426 | 11 | 31 |
| 355 | 1978 | 57 | 76 |
| 356 | 1881 | 60 | 80 |
| 357 | 1974 | 163 | 182 |
| 358 | 2466 | 11 | 30 |
| 359 | 1633 | 44 | 63 |
| 359 | 1797 | 102 | 121 |
| 359 | 1889 | 11 | 30 |
| 359 | 2128 | 281 | 300 |
| 359 | 2129 | 11 | 30 |
| 359 | 2254 | 11 | 30 |
| 360 | 2241 | 115 | 135 |
| 360 | 2363 | 114 | 134 |
| 361 | 2117 | 39 | 58 |
| 361 | 2513 | 11 | 30 |
| 361 | 2530 | 39 | 58 |
| 362 | 2533 | 51 | 69 |
| 363 | 1707 | 89 | 109 |
| 364 | 1801 | 41 | 61 |
| 365 | 2428 | 41 | 61 |
| 366 | 2221 | 31 | 50 |
| 366 | 2439 | 280 | 299 |
| 367 | 1852 | 29 | 48 |
| 367 | 2252 | 30 | 49 |
| 368 | 2069 | 11 | 30 |
| 369 | 2462 | 11 | 30 |
| 370 | 2031 | 11 | 30 |
| 371 | 2197 | 36 | 56 |
| 372 | 2603 | 11 | 30 |
| 373 | 2111 | 74 | 93 |
| 374 | 1790 | 11 | 31 |
| 375 | 1840 | 89 | 112 |
| 375 | 2463 | 89 | 112 |
| 375 | 2634 | 89 | 112 |
| 375 | 2655 | 89 | 112 |
| 376 | 1866 | 50 | 70 |
| 376 | 2004 | 280 | 300 |
| 377 | 1714 | 271 | 290 |
| 377 | 2482 | 271 | 290 |
| 378 | 2587 | 11 | 31 |
| 379 | 1675 | 11 | 31 |
| 379 | 2234 | 11 | 31 |
| 380 | 2249 | 11 | 31 |
| 381 | 1701 | 11 | 29 |
| 382 | 2555 | 64 | 83 |
| 383 | 2271 | 11 | 30 |
| 384 | 1796 | 45 | 64 |
| 385 | 2113 | 11 | 31 |
| 385 | 2230 | 60 | 80 |
| 385 | 2277 | 11 | 31 |
| 385 | 2302 | 11 | 31 |
| 385 | 2392 | 11 | 31 |
| 385 | 2590 | 60 | 80 |
| 386 | 1883 | 210 | 229 |
| 387 | 2494 | 40 | 59 |
| 388 | 1928 | 11 | 31 |
| 388 | 2193 | 11 | 31 |
| 388 | 2617 | 11 | 31 |
| 389 | 2013 | 11 | 30 |
| 390 | 1862 | 11 | 30 |
| 391 | 1824 | 276 | 294 |
| 391 | 1984 | 152 | 170 |
| 391 | 1985 | 11 | 29 |
| 392 | 1968 | 11 | 30 |
| 392 | 2505 | 11 | 30 |
| 393 | 1763 | 108 | 128 |
| 394 | 1667 | 137 | 157 |
| 395 | 1952 | 11 | 30 |
| 395 | 1983 | 11 | 30 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 396 | 1789 | 11 | 31 |
| 397 | 1907 | 42 | 60 |
| 398 | 2668 | 11 | 31 |
| 399 | 2138 | 11 | 31 |
| 400 | 2175 | 11 | 31 |
| 401 | 2323 | 11 | 31 |
| 402 | 2669 | 11 | 31 |
| 403 | 1795 | 95 | 114 |
| 403 | 2326 | 11 | 30 |
| 404 | 1948 | 47 | 67 |
| 404 | 2380 | 47 | 67 |
| 405 | 2470 | 11 | 30 |
| 406 | 1680 | 11 | 31 |
| 406 | 2355 | 11 | 31 |
| 407 | 2251 | 64 | 83 |
| 408 | 2499 | 71 | 90 |
| 409 | 1911 | 11 | 34 |
| 410 | 2162 | 11 | 30 |
| 411 | 2360 | 11 | 31 |
| 412 | 2073 | 11 | 30 |
| 413 | 2231 | 35 | 55 |
| 414 | 1637 | 11 | 30 |
| 415 | 1673 | 11 | 30 |
| 416 | 1819 | 11 | 29 |
| 417 | 2529 | 49 | 68 |
| 418 | 1785 | 277 | 296 |
| 419 | 2379 | 45 | 65 |
| 420 | 1958 | 248 | 268 |
| 420 | 2123 | 248 | 268 |
| 420 | 2218 | 247 | 267 |
| 421 | 1874 | 71 | 91 |
| 422 | 2352 | 11 | 30 |
| 422 | 2635 | 11 | 30 |
| 423 | 2297 | 245 | 265 |
| 424 | 2680 | 280 | 298 |
| 425 | 2552 | 252 | 272 |
| 426 | 1893 | 11 | 34 |
| 427 | 2068 | 183 | 203 |
| 428 | 2225 | 165 | 184 |
| 429 | 1738 | 11 | 31 |
| 430 | 2640 | 11 | 31 |
| 431 | 2083 | 11 | 30 |
| 432 | 2233 | 221 | 241 |
| 433 | 2097 | 102 | 121 |
| 434 | 2623 | 11 | 29 |
| 435 | 2272 | 11 | 34 |
| 436 | 2246 | 11 | 30 |
| 436 | 2449 | 11 | 30 |
| 437 | 2217 | 11 | 31 |
| 438 | 1638 | 11 | 29 |
| 438 | 1639 | 273 | 291 |
| 438 | 1695 | 11 | 29 |
| 439 | 2227 | 124 | 144 |
| 439 | 2660 | 118 | 138 |
| 440 | 1688 | 90 | 110 |
| 441 | 1622 | 120 | 140 |
| 442 | 2388 | 34 | 54 |
| 443 | 1708 | 240 | 258 |
| 443 | 1709 | 11 | 29 |
| 443 | 2179 | 11 | 29 |
| 443 | 2547 | 11 | 29 |
| 444 | 1699 | 11 | 31 |
| 444 | 2099 | 11 | 31 |
| 445 | 2550 | 11 | 31 |
| 445 | 2601 | 11 | 31 |
| 446 | 2020 | 11 | 31 |
| 447 | 1915 | 281 | 300 |
| 447 | 1916 | 11 | 30 |
| 448 | 1705 | 174 | 193 |
| 448 | 2027 | 173 | 192 |
| 449 | 1677 | 11 | 31 |
| 450 | 1870 | 77 | 97 |
| 451 | 1781 | 11 | 31 |
| 452 | 2480 | 85 | 105 |
| 452 | 2512 | 84 | 104 |
| 453 | 2454 | 129 | 149 |
| 454 | 1719 | 48 | 68 |
| 454 | 2347 | 48 | 68 |
| 455 | 2435 | 11 | 31 |
| 456 | 1811 | 11 | 31 |
| 456 | 2154 | 11 | 31 |
| 457 | 1901 | 207 | 227 |
| 458 | 1917 | 174 | 194 |
| 459 | 2053 | 55 | 74 |
| 460 | 2476 | 11 | 32 |
| 461 | 2091 | 11 | 30 |
| 462 | 1668 | 46 | 65 |
| 462 | 2503 | 46 | 65 |
| 463 | 2420 | 254 | 274 |
| 464 | 2626 | 281 | 302 |
| 465 | 2468 | 281 | 301 |
| 466 | 1908 | 281 | 301 |
| 467 | 2247 | 203 | 222 |
| 467 | 2553 | 182 | 201 |
| 468 | 2455 | 11 | 30 |
| 469 | 1859 | 34 | 54 |
| 469 | 2334 | 34 | 54 |
| 470 | 1828 | 11 | 30 |
| 471 | 2586 | 11 | 30 |
| 472 | 2014 | 11 | 30 |
| 473 | 1788 | 11 | 31 |
| 474 | 2632 | 11 | 31 |
| 475 | 2509 | 11 | 31 |
| 476 | 2535 | 11 | 30 |
| 477 | 2147 | 11 | 31 |
| 478 | 1960 | 11 | 31 |
| 479 | 1783 | 11 | 31 |
| 480 | 2541 | 11 | 31 |
| 481 | 2169 | 202 | 221 |
| 482 | 1703 | 147 | 167 |
| 483 | 1775 | 148 | 168 |
| 484 | 1839 | 11 | 30 |
| 485 | 2119 | 56 | 76 |
| 486 | 1906 | 152 | 170 |
| 486 | 2143 | 11 | 29 |
| 487 | 2633 | 76 | 96 |
| 488 | 1734 | 132 | 150 |
| 488 | 2045 | 133 | 151 |
| 488 | 2506 | 129 | 147 |
| 488 | 2672 | 134 | 152 |
| 489 | 1772 | 58 | 78 |
| 490 | 1687 | 11 | 34 |
| 491 | 2649 | 76 | 96 |
| 492 | 2436 | 73 | 93 |
| 493 | 1798 | 11 | 31 |
| 494 | 2335 | 11 | 30 |
| 495 | 2568 | 11 | 31 |
| 496 | 2627 | 80 | 100 |
| 497 | 2461 | 11 | 31 |
| 498 | 1745 | 141 | 161 |
| 498 | 1949 | 11 | 31 |
| 499 | 2130 | 30 | 50 |
| 500 | 1660 | 11 | 30 |
| 501 | 2002 | 11 | 30 |
| 502 | 1882 | 11 | 31 |
| 503 | 1956 | 11 | 34 |
| 504 | 1694 | 11 | 30 |
| 504 | 1903 | 11 | 30 |
| 504 | 2395 | 11 | 30 |
| 504 | 2515 | 11 | 30 |
| 505 | 2151 | 279 | 300 |
| 506 | 1787 | 11 | 31 |
| 506 | 2126 | 89 | 109 |
| 506 | 2127 | 11 | 31 |
| 507 | 2317 | 135 | 154 |
| 508 | 2180 | 11 | 31 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 509 | 2346 | 11 | 31 |
| 509 | 2645 | 11 | 31 |
| 510 | 1936 | 11 | 30 |
| 510 | 2516 | 11 | 30 |
| 511 | 2245 | 11 | 30 |
| 512 | 2354 | 137 | 157 |
| 512 | 2478 | 141 | 161 |
| 513 | 2411 | 47 | 67 |
| 514 | 1716 | 35 | 55 |
| 515 | 2283 | 11 | 31 |
| 516 | 2095 | 11 | 31 |
| 517 | 2432 | 11 | 31 |
| 518 | 2608 | 165 | 185 |
| 519 | 2041 | 11 | 30 |
| 520 | 2487 | 11 | 31 |
| 521 | 1757 | 35 | 54 |
| 522 | 1702 | 221 | 241 |
| 523 | 1792 | 72 | 94 |
| 523 | 2266 | 62 | 84 |
| 524 | 2258 | 11 | 31 |
| 525 | 2458 | 65 | 85 |
| 526 | 1682 | 80 | 100 |
| 526 | 1760 | 66 | 86 |
| 526 | 2035 | 80 | 100 |
| 526 | 2253 | 62 | 82 |
| 527 | 1765 | 42 | 62 |
| 528 | 2098 | 11 | 30 |
| 529 | 1710 | 196 | 215 |
| 530 | 2371 | 124 | 143 |
| 531 | 1920 | 11 | 30 |
| 532 | 2396 | 11 | 31 |
| 533 | 2518 | 126 | 145 |
| 534 | 1962 | 255 | 276 |
| 535 | 2366 | 54 | 74 |
| 536 | 2671 | 234 | 254 |
| 537 | 2308 | 178 | 197 |
| 538 | 1953 | 11 | 31 |
| 539 | 1704 | 41 | 60 |
| 540 | 1768 | 133 | 153 |
| 540 | 1803 | 129 | 149 |
| 540 | 2114 | 216 | 236 |
| 541 | 2374 | 11 | 31 |
| 542 | 2613 | 11 | 30 |
| 543 | 1820 | 176 | 195 |
| 544 | 1776 | 11 | 31 |
| 545 | 1897 | 158 | 177 |
| 546 | 2434 | 112 | 132 |
| 546 | 2517 | 112 | 132 |
| 547 | 2168 | 11 | 31 |
| 547 | 2690 | 11 | 31 |
| 548 | 1794 | 11 | 30 |
| 549 | 2311 | 55 | 75 |
| 550 | 1676 | 11 | 31 |
| 551 | 2131 | 11 | 31 |
| 552 | 1753 | 11 | 31 |
| 553 | 1867 | 11 | 31 |
| 554 | 2544 | 11 | 31 |
| 555 | 2407 | 11 | 31 |
| 556 | 2595 | 270 | 290 |
| 557 | 1681 | 251 | 271 |
| 557 | 2339 | 251 | 271 |
| 557 | 2375 | 222 | 242 |
| 557 | 2473 | 251 | 271 |
| 557 | 2589 | 251 | 271 |
| 558 | 2236 | 82 | 102 |
| 559 | 2629 | 11 | 30 |
| 560 | 1832 | 177 | 197 |
| 561 | 1737 | 11 | 31 |
| 562 | 2523 | 11 | 31 |
| 563 | 1625 | 11 | 31 |
| 563 | 2327 | 281 | 301 |
| 564 | 1930 | 55 | 74 |
| 564 | 2560 | 55 | 74 |
| 565 | 2325 | 40 | 60 |
| 566 | 1725 | 115 | 135 |
| 567 | 1684 | 11 | 31 |
| 568 | 1729 | 272 | 290 |
| 568 | 1766 | 205 | 223 |
| 568 | 2108 | 119 | 137 |
| 568 | 2307 | 262 | 280 |
| 568 | 2367 | 11 | 29 |
| 569 | 2644 | 54 | 73 |
| 570 | 1947 | 11 | 31 |
| 570 | 2185 | 11 | 31 |
| 570 | 2384 | 11 | 31 |
| 571 | 2594 | 78 | 97 |
| 572 | 2062 | 11 | 31 |
| 573 | 2290 | 232 | 250 |
| 574 | 2314 | 11 | 31 |
| 575 | 1793 | 11 | 31 |
| 576 | 1645 | 59 | 79 |
| 576 | 2239 | 280 | 300 |
| 577 | 2293 | 111 | 130 |
| 578 | 1629 | 11 | 30 |
| 579 | 2643 | 11 | 31 |
| 580 | 1970 | 11 | 30 |
| 581 | 1929 | 11 | 33 |
| 582 | 2538 | 11 | 30 |
| 583 | 1786 | 102 | 122 |
| 583 | 2639 | 50 | 70 |
| 584 | 1986 | 11 | 34 |
| 585 | 1698 | 53 | 72 |
| 585 | 2391 | 54 | 73 |
| 586 | 1894 | 11 | 30 |
| 587 | 2559 | 213 | 231 |
| 587 | 2576 | 11 | 29 |
| 588 | 1619 | 36 | 56 |
| 589 | 1868 | 11 | 30 |
| 590 | 1621 | 281 | 299 |
| 591 | 2067 | 245 | 265 |
| 592 | 2457 | 11 | 31 |
| 593 | 2163 | 11 | 31 |
| 594 | 2207 | 11 | 30 |
| 595 | 2190 | 34 | 53 |
| 596 | 2206 | 30 | 49 |
| 597 | 2364 | 11 | 31 |
| 598 | 2673 | 11 | 31 |
| 599 | 1886 | 244 | 264 |
| 600 | 1844 | 68 | 87 |
| 601 | 2016 | 11 | 31 |
| 601 | 2089 | 11 | 31 |
| 601 | 2161 | 11 | 31 |
| 601 | 2306 | 11 | 31 |
| 601 | 2429 | 11 | 31 |
| 602 | 2332 | 37 | 57 |
| 603 | 2338 | 68 | 88 |
| 604 | 2638 | 74 | 93 |
| 605 | 2036 | 11 | 29 |
| 606 | 2619 | 11 | 32 |
| 607 | 2001 | 90 | 109 |
| 608 | 1640 | 11 | 29 |
| 608 | 2502 | 11 | 29 |
| 609 | 1964 | 69 | 87 |
| 610 | 2152 | 11 | 31 |
| 611 | 1764 | 11 | 31 |
| 612 | 2146 | 179 | 198 |
| 613 | 1837 | 190 | 210 |
| 614 | 2427 | 105 | 125 |
| 615 | 2178 | 11 | 30 |
| 616 | 1750 | 11 | 31 |
| 616 | 1923 | 11 | 31 |
| 616 | 2172 | 11 | 31 |
| 616 | 2259 | 11 | 31 |
| 616 | 2275 | 11 | 31 |
| 616 | 2610 | 11 | 31 |
| 617 | 2548 | 112 | 132 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 618 | 2135 | 84 | 104 |
| 619 | 2479 | 100 | 119 |
| 620 | 2007 | 55 | 75 |
| 620 | 2008 | 11 | 31 |
| 621 | 1642 | 91 | 111 |
| 621 | 1865 | 98 | 118 |
| 621 | 2048 | 106 | 126 |
| 622 | 1654 | 11 | 30 |
| 623 | 2526 | 11 | 31 |
| 624 | 2410 | 11 | 31 |
| 625 | 2450 | 11 | 31 |
| 626 | 2571 | 274 | 292 |
| 627 | 1649 | 11 | 31 |
| 627 | 1717 | 11 | 31 |
| 627 | 1943 | 11 | 31 |
| 627 | 2094 | 11 | 31 |
| 627 | 2260 | 11 | 31 |
| 627 | 2303 | 11 | 31 |
| 627 | 2593 | 11 | 31 |
| 628 | 2646 | 125 | 145 |
| 629 | 2378 | 40 | 60 |
| 630 | 2451 | 53 | 72 |
| 631 | 1885 | 133 | 151 |
| 632 | 2153 | 245 | 264 |
| 633 | 2689 | 11 | 31 |
| 634 | 2133 | 11 | 31 |
| 635 | 1657 | 11 | 30 |
| 635 | 2040 | 80 | 99 |
| 636 | 2419 | 126 | 145 |
| 637 | 2024 | 247 | 265 |
| 638 | 1770 | 11 | 31 |
| 639 | 1626 | 73 | 93 |
| 640 | 2220 | 95 | 115 |
| 641 | 2430 | 11 | 31 |
| 642 | 2181 | 11 | 31 |
| 643 | 2447 | 11 | 31 |
| 644 | 1647 | 127 | 150 |
| 644 | 1995 | 183 | 206 |
| 644 | 2546 | 184 | 207 |
| 645 | 2324 | 11 | 31 |
| 646 | 2101 | 222 | 241 |
| 647 | 1931 | 11 | 31 |
| 648 | 1863 | 35 | 54 |
| 648 | 2115 | 279 | 298 |
| 649 | 2630 | 11 | 31 |
| 650 | 2609 | 84 | 103 |
| 651 | 2165 | 39 | 58 |
| 652 | 1980 | 38 | 58 |
| 653 | 2390 | 274 | 294 |
| 654 | 1918 | 105 | 125 |
| 655 | 1779 | 11 | 31 |
| 656 | 2424 | 110 | 129 |
| 657 | 1944 | 33 | 52 |
| 658 | 2049 | 165 | 184 |
| 659 | 2282 | 67 | 87 |
| 660 | 2194 | 11 | 30 |
| 661 | 2000 | 281 | 300 |
| 662 | 2061 | 275 | 295 |
| 663 | 2562 | 11 | 31 |
| 664 | 1988 | 11 | 30 |
| 665 | 1722 | 281 | 300 |
| 666 | 2285 | 11 | 31 |
| 667 | 2318 | 11 | 34 |
| 668 | 2421 | 11 | 31 |
| 669 | 2021 | 236 | 256 |
| 670 | 2212 | 146 | 166 |
| 671 | 1623 | 47 | 65 |
| 672 | 2029 | 11 | 30 |
| 673 | 1810 | 11 | 31 |
| 674 | 1875 | 11 | 31 |
| 675 | 2284 | 107 | 127 |
| 675 | 2397 | 107 | 127 |
| 676 | 2109 | 11 | 31 |
| 677 | 2337 | 11 | 30 |
| 678 | 1942 | 11 | 30 |
| 679 | 2572 | 11 | 31 |
| 680 | 2173 | 11 | 30 |
| 681 | 1992 | 11 | 31 |
| 682 | 1849 | 11 | 30 |
| 683 | 2565 | 63 | 82 |
| 684 | 2086 | 11 | 30 |
| 685 | 2561 | 53 | 72 |
| 685 | 2625 | 53 | 72 |
| 686 | 1834 | 60 | 80 |
| 687 | 2077 | 11 | 30 |
| 688 | 2051 | 92 | 112 |
| 688 | 2508 | 81 | 101 |
| 689 | 2484 | 11 | 31 |
| 690 | 1666 | 68 | 89 |
| 691 | 2105 | 11 | 30 |
| 691 | 2599 | 11 | 30 |
| 692 | 1630 | 33 | 53 |
| 693 | 1971 | 68 | 88 |
| 694 | 2047 | 11 | 30 |
| 695 | 1674 | 207 | 226 |
| 695 | 1909 | 72 | 91 |
| 695 | 2198 | 246 | 265 |
| 695 | 2199 | 11 | 30 |
| 695 | 2537 | 80 | 99 |
| 696 | 2319 | 11 | 35 |
| 697 | 2011 | 195 | 215 |
| 698 | 1818 | 11 | 29 |
| 698 | 1846 | 11 | 29 |
| 698 | 2030 | 11 | 29 |
| 698 | 2166 | 11 | 29 |
| 698 | 2242 | 37 | 55 |
| 698 | 2674 | 62 | 80 |
| 698 | 2675 | 11 | 29 |
| 699 | 2647 | 11 | 31 |
| 700 | 2686 | 214 | 234 |
| 701 | 2018 | 151 | 170 |
| 701 | 2351 | 125 | 144 |
| 702 | 2614 | 234 | 253 |
| 703 | 1957 | 11 | 31 |
| 704 | 1731 | 11 | 30 |
| 705 | 2079 | 218 | 238 |
| 706 | 2370 | 281 | 301 |
| 707 | 2340 | 11 | 31 |
| 708 | 1830 | 11 | 31 |
| 709 | 1921 | 11 | 31 |
| 710 | 2093 | 33 | 52 |
| 711 | 1665 | 191 | 210 |
| 712 | 2651 | 11 | 31 |
| 713 | 2534 | 79 | 100 |
| 713 | 2662 | 79 | 100 |
| 714 | 2144 | 11 | 35 |
| 715 | 2064 | 11 | 31 |
| 716 | 2545 | 86 | 105 |
| 717 | 1636 | 11 | 31 |
| 718 | 2248 | 11 | 30 |
| 719 | 2320 | 11 | 30 |
| 720 | 1739 | 99 | 119 |
| 721 | 2286 | 11 | 31 |
| 722 | 2321 | 11 | 31 |
| 723 | 2216 | 36 | 55 |
| 724 | 1814 | 82 | 105 |
| 725 | 2288 | 11 | 30 |
| 726 | 2256 | 245 | 263 |
| 727 | 1905 | 11 | 31 |
| 727 | 2440 | 11 | 31 |
| 728 | 1998 | 71 | 91 |
| 729 | 1624 | 54 | 74 |
| 730 | 1940 | 11 | 31 |
| 730 | 2328 | 111 | 131 |
| 731 | 1662 | 11 | 29 |
| 732 | 2118 | 11 | 30 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 733 | 1809 | 60 | 79 |
| 733 | 2037 | 183 | 202 |
| 733 | 2150 | 73 | 92 |
| 734 | 2596 | 11 | 31 |
| 735 | 2414 | 11 | 31 |
| 736 | 2192 | 11 | 31 |
| 737 | 2196 | 11 | 30 |
| 738 | 2521 | 39 | 59 |
| 739 | 1678 | 11 | 31 |
| 740 | 1791 | 152 | 172 |
| 740 | 1853 | 158 | 178 |
| 740 | 2134 | 155 | 175 |
| 741 | 2058 | 129 | 149 |
| 742 | 1635 | 194 | 214 |
| 742 | 1914 | 11 | 31 |
| 742 | 2362 | 11 | 31 |
| 743 | 1653 | 220 | 238 |
| 743 | 2104 | 281 | 299 |
| 744 | 2300 | 11 | 31 |
| 745 | 1648 | 82 | 102 |
| 746 | 2423 | 11 | 30 |
| 746 | 2648 | 11 | 30 |
| 747 | 2305 | 11 | 30 |
| 748 | 1855 | 11 | 30 |
| 748 | 1961 | 11 | 30 |
| 749 | 1982 | 11 | 34 |
| 749 | 2022 | 11 | 34 |
| 749 | 2075 | 11 | 34 |
| 749 | 2292 | 11 | 34 |
| 750 | 2344 | 11 | 29 |
| 751 | 2019 | 53 | 73 |
| 752 | 1758 | 74 | 94 |
| 753 | 1780 | 32 | 52 |
| 754 | 2631 | 99 | 119 |
| 755 | 2564 | 11 | 31 |
| 756 | 2570 | 11 | 31 |
| 757 | 2574 | 44 | 63 |
| 758 | 1880 | 11 | 29 |
| 759 | 1799 | 11 | 31 |
| 760 | 2469 | 85 | 104 |
| 761 | 2066 | 11 | 30 |
| 762 | 1826 | 11 | 31 |
| 763 | 2382 | 11 | 31 |
| 764 | 2132 | 233 | 253 |
| 764 | 2177 | 233 | 253 |
| 765 | 2688 | 11 | 31 |
| 766 | 1773 | 87 | 105 |
| 767 | 2160 | 11 | 31 |
| 768 | 1945 | 225 | 244 |
| 769 | 2342 | 266 | 284 |
| 770 | 1712 | 102 | 121 |
| 771 | 2087 | 11 | 30 |
| 771 | 2235 | 11 | 30 |
| 771 | 2567 | 11 | 30 |
| 772 | 2270 | 11 | 31 |
| 772 | 2312 | 11 | 31 |
| 772 | 2383 | 11 | 31 |
| 772 | 2657 | 11 | 31 |
| 773 | 2176 | 178 | 197 |
| 774 | 1748 | 11 | 30 |
| 774 | 1842 | 11 | 30 |
| 775 | 1723 | 45 | 64 |
| 775 | 2615 | 45 | 64 |
| 776 | 2072 | 11 | 31 |
| 777 | 1655 | 11 | 30 |
| 778 | 1989 | 123 | 146 |
| 779 | 2032 | 11 | 30 |
| 779 | 2263 | 11 | 30 |
| 779 | 2425 | 11 | 30 |
| 779 | 2620 | 11 | 30 |
| 780 | 1805 | 11 | 30 |
| 780 | 2149 | 11 | 30 |
| 780 | 2331 | 11 | 30 |
| 780 | 2477 | 11 | 30 |
| 780 | 2511 | 11 | 30 |
| 781 | 2563 | 164 | 184 |
| 782 | 2208 | 149 | 168 |
| 783 | 2186 | 275 | 294 |
| 784 | 1823 | 11 | 32 |
| 785 | 1879 | 11 | 31 |
| 786 | 2666 | 11 | 31 |
| 787 | 2490 | 279 | 298 |
| 788 | 1752 | 11 | 31 |
| 789 | 2052 | 89 | 109 |
| 789 | 2628 | 89 | 109 |
| 790 | 1733 | 62 | 82 |
| 791 | 1777 | 11 | 31 |
| 791 | 2412 | 11 | 31 |
| 791 | 2658 | 11 | 31 |
| 792 | 1898 | 281 | 301 |
| 793 | 1815 | 138 | 157 |
| 794 | 2456 | 181 | 201 |
| 795 | 2112 | 159 | 178 |
| 796 | 1740 | 116 | 136 |
| 797 | 2359 | 11 | 32 |
| 798 | 2441 | 11 | 31 |
| 799 | 2585 | 11 | 31 |
| 800 | 2665 | 11 | 31 |
| 801 | 2313 | 237 | 256 |
| 802 | 1941 | 11 | 30 |
| 803 | 1646 | 130 | 150 |
| 804 | 2349 | 11 | 31 |
| 805 | 1720 | 147 | 167 |
| 805 | 2191 | 147 | 167 |
| 806 | 2100 | 11 | 30 |
| 807 | 1659 | 269 | 289 |
| 808 | 2229 | 269 | 289 |
| 809 | 2443 | 281 | 300 |
| 810 | 2600 | 114 | 134 |
| 811 | 2215 | 216 | 236 |
| 812 | 1693 | 11 | 30 |
| 813 | 1749 | 72 | 92 |
| 813 | 2156 | 72 | 92 |
| 813 | 2278 | 72 | 92 |
| 813 | 2416 | 72 | 92 |
| 813 | 2551 | 116 | 136 |
| 814 | 2195 | 11 | 31 |
| 815 | 2281 | 271 | 291 |
| 816 | 2264 | 11 | 30 |
| 817 | 1711 | 11 | 30 |
| 818 | 1981 | 11 | 31 |
| 819 | 1854 | 11 | 30 |
| 820 | 2413 | 148 | 168 |
| 821 | 2404 | 262 | 282 |
| 822 | 2090 | 44 | 64 |
| 822 | 2654 | 112 | 132 |
| 823 | 2525 | 44 | 64 |
| 824 | 2402 | 128 | 147 |
| 824 | 2606 | 135 | 154 |
| 825 | 2387 | 11 | 31 |
| 826 | 1762 | 11 | 31 |
| 827 | 1895 | 36 | 55 |
| 828 | 2467 | 11 | 31 |
| 829 | 2102 | 11 | 31 |
| 830 | 2588 | 11 | 30 |
| 831 | 1671 | 11 | 31 |
| 832 | 1650 | 11 | 30 |
| 833 | 1843 | 281 | 300 |
| 834 | 1976 | 30 | 49 |
| 834 | 2448 | 30 | 49 |
| 835 | 2125 | 11 | 30 |
| 836 | 2255 | 11 | 31 |
| 837 | 2683 | 37 | 56 |
| 838 | 2274 | 11 | 30 |
| 839 | 1634 | 11 | 31 |
| 840 | 2605 | 281 | 300 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 841 | 2497 | 124 | 143 |
| 842 | 2685 | 11 | 31 |
| 843 | 2376 | 281 | 301 |
| 844 | 1925 | 82 | 102 |
| 845 | 2438 | 11 | 31 |
| 846 | 2607 | 11 | 31 |
| 847 | 2398 | 71 | 90 |
| 848 | 2459 | 165 | 185 |
| 849 | 2460 | 234 | 254 |
| 850 | 1975 | 11 | 30 |
| 851 | 2579 | 11 | 30 |
| 852 | 2042 | 11 | 30 |
| 852 | 2385 | 85 | 104 |
| 853 | 1933 | 11 | 31 |
| 854 | 2159 | 214 | 234 |
| 854 | 2369 | 214 | 234 |
| 855 | 2187 | 41 | 60 |
| 855 | 2237 | 44 | 63 |
| 856 | 2269 | 207 | 227 |
| 857 | 2050 | 11 | 31 |
| 858 | 1987 | 82 | 101 |
| 859 | 1656 | 11 | 31 |
| 860 | 2210 | 11 | 31 |
| 861 | 1900 | 11 | 30 |
| 861 | 1979 | 11 | 30 |
| 862 | 1727 | 44 | 64 |
| 863 | 2205 | 200 | 220 |
| 864 | 2164 | 53 | 71 |
| 865 | 2498 | 11 | 30 |
| 866 | 1769 | 42 | 62 |
| 867 | 1726 | 31 | 50 |
| 868 | 1652 | 11 | 29 |
| 868 | 1730 | 156 | 174 |
| 868 | 1884 | 11 | 29 |
| 868 | 1967 | 11 | 29 |
| 869 | 1821 | 279 | 299 |
| 870 | 1620 | 11 | 31 |
| 871 | 1767 | 281 | 300 |
| 872 | 2155 | 11 | 31 |
| 873 | 1800 | 39 | 57 |
| 874 | 2501 | 11 | 31 |
| 875 | 2211 | 226 | 246 |
| 876 | 2009 | 11 | 31 |
| 877 | 2110 | 11 | 31 |
| 878 | 1991 | 11 | 30 |
| 879 | 2044 | 11 | 29 |
| 880 | 1833 | 11 | 31 |
| 881 | 2124 | 173 | 193 |
| 882 | 2408 | 11 | 31 |
| 883 | 1751 | 122 | 142 |
| 884 | 1744 | 11 | 31 |
| 885 | 2289 | 190 | 209 |
| 886 | 1825 | 11 | 31 |
| 887 | 2171 | 11 | 30 |
| 888 | 2345 | 11 | 31 |
| 889 | 2034 | 50 | 69 |
| 890 | 2059 | 11 | 31 |
| 891 | 2026 | 194 | 212 |
| 892 | 2573 | 11 | 32 |
| 893 | 1689 | 11 | 30 |
| 893 | 2201 | 11 | 30 |
| 894 | 1904 | 56 | 76 |
| 895 | 2209 | 11 | 30 |
| 896 | 1736 | 11 | 30 |
| 897 | 2295 | 100 | 120 |
| 898 | 2330 | 11 | 31 |
| 899 | 1664 | 281 | 300 |
| 900 | 2641 | 54 | 74 |
| 901 | 2678 | 11 | 31 |
| 902 | 1932 | 11 | 31 |
| 903 | 1841 | 11 | 31 |
| 903 | 2583 | 11 | 31 |
| 903 | 2661 | 11 | 31 |
| 904 | 2348 | 70 | 90 |
| 905 | 2650 | 11 | 31 |
| 906 | 2507 | 46 | 65 |
| 907 | 1910 | 47 | 66 |
| 907 | 2618 | 35 | 54 |
| 908 | 2057 | 134 | 154 |
| 909 | 2070 | 11 | 31 |
| 909 | 2667 | 11 | 31 |
| 910 | 2167 | 73 | 92 |
| 911 | 2310 | 68 | 88 |
| 912 | 2578 | 11 | 30 |
| 913 | 1706 | 33 | 53 |
| 914 | 1670 | 34 | 54 |
| 915 | 1683 | 71 | 91 |
| 916 | 1754 | 11 | 31 |
| 916 | 2226 | 11 | 31 |
| 917 | 2028 | 272 | 292 |
| 918 | 2214 | 11 | 30 |
| 919 | 1806 | 84 | 104 |
| 920 | 2333 | 281 | 301 |
| 921 | 2316 | 11 | 30 |
| 922 | 2025 | 11 | 31 |
| 922 | 2315 | 11 | 31 |
| 922 | 2405 | 11 | 31 |
| 922 | 2437 | 11 | 31 |
| 923 | 2357 | 261 | 281 |
| 924 | 2381 | 11 | 31 |
| 925 | 1871 | 82 | 101 |
| 926 | 2433 | 186 | 205 |
| 927 | 2377 | 273 | 292 |
| 928 | 1632 | 270 | 290 |
| 929 | 2485 | 118 | 138 |
| 930 | 2540 | 11 | 30 |
| 930 | 2602 | 11 | 30 |
| 930 | 2670 | 11 | 30 |
| 931 | 1812 | 11 | 31 |
| 932 | 2294 | 240 | 260 |
| 933 | 2687 | 37 | 56 |
| 934 | 2401 | 86 | 106 |
| 935 | 2084 | 11 | 31 |
| 936 | 1661 | 113 | 133 |
| 936 | 1939 | 112 | 132 |
| 936 | 2088 | 112 | 132 |
| 936 | 2677 | 90 | 110 |
| 937 | 2078 | 11 | 30 |
| 938 | 1934 | 273 | 292 |
| 939 | 1851 | 280 | 298 |
| 940 | 1817 | 11 | 30 |
| 941 | 1835 | 11 | 30 |
| 942 | 2495 | 11 | 30 |
| 943 | 2267 | 130 | 150 |
| 944 | 2621 | 11 | 31 |
| 945 | 1782 | 11 | 30 |
| 946 | 1669 | 11 | 31 |
| 947 | 2403 | 36 | 55 |
| 948 | 1927 | 11 | 31 |
| 949 | 2287 | 11 | 31 |
| 950 | 2356 | 11 | 31 |
| 951 | 2015 | 131 | 151 |
| 952 | 2616 | 11 | 29 |
| 953 | 2486 | 64 | 83 |
| 954 | 1899 | 255 | 275 |
| 955 | 1742 | 132 | 151 |
| 956 | 2493 | 11 | 30 |
| 957 | 1715 | 11 | 31 |
| 958 | 2492 | 11 | 31 |
| 959 | 1997 | 11 | 31 |
| 959 | 2213 | 11 | 31 |
| 960 | 1966 | 75 | 95 |
| 961 | 2012 | 11 | 31 |
| 962 | 2224 | 11 | 31 |
| 963 | 2188 | 176 | 195 |
| 964 | 2598 | 58 | 78 |

TABLE 1-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 965 | 2418 | 11 | 30 |
| 966 | 2444 | 11 | 30 |
| 967 | 2372 | 11 | 31 |
| 968 | 1888 | 11 | 31 |
| 969 | 1651 | 11 | 31 |
| 970 | 2652 | 11 | 30 |
| 971 | 1965 | 275 | 295 |
| 972 | 1743 | 11 | 31 |
| 973 | 1877 | 11 | 33 |
| 974 | 2386 | 274 | 293 |
| 975 | 2580 | 11 | 31 |
| 976 | 2637 | 281 | 300 |
| 977 | 2577 | 39 | 59 |
| 978 | 1836 | 128 | 148 |
| 979 | 2452 | 11 | 30 |
| 980 | 2076 | 76 | 96 |
| 981 | 1838 | 281 | 301 |
| 982 | 1690 | 11 | 31 |
| 983 | 2222 | 11 | 30 |
| 984 | 1935 | 11 | 31 |
| 985 | 1816 | 11 | 30 |
| 986 | 1628 | 11 | 30 |
| 987 | 2504 | 11 | 31 |
| 988 | 2350 | 234 | 253 |
| 989 | 1831 | 11 | 30 |
| 990 | 2065 | 11 | 30 |
| 991 | 2142 | 11 | 31 |
| 992 | 1896 | 11 | 31 |
| 993 | 1672 | 11 | 34 |
| 994 | 2624 | 11 | 31 |
| 995 | 1959 | 97 | 117 |
| 996 | 2238 | 235 | 255 |
| 996 | 2612 | 271 | 291 |
| 997 | 1972 | 238 | 258 |
| 998 | 2204 | 11 | 31 |
| 999 | 2496 | 94 | 114 |
| 1000 | 2055 | 79 | 99 |
| 1001 | 1691 | 11 | 34 |
| 1002 | 2336 | 11 | 30 |
| 1003 | 2096 | 11 | 31 |
| 1003 | 2539 | 131 | 151 |
| 1004 | 2085 | 11 | 31 |
| 1005 | 2298 | 11 | 31 |
| 1006 | 1641 | 245 | 264 |
| 1006 | 1996 | 11 | 30 |
| 1006 | 2203 | 11 | 30 |
| 1007 | 2679 | 153 | 173 |
| 1008 | 1741 | 11 | 31 |
| 1008 | 2322 | 11 | 31 |
| 1009 | 2642 | 11 | 29 |
| 1010 | 2442 | 11 | 31 |
| 1011 | 2575 | 11 | 31 |
| 1012 | 2250 | 11 | 31 |
| 1013 | 1732 | 54 | 77 |
| 1013 | 2060 | 53 | 76 |
| 1013 | 2453 | 53 | 76 |
| 1014 | 2170 | 60 | 80 |
| 1015 | 2611 | 35 | 55 |
| 1016 | 2033 | 91 | 111 |
| 1017 | 2569 | 135 | 155 |
| 1018 | 2361 | 11 | 31 |
| 1019 | 1718 | 11 | 31 |
| 1020 | 2558 | 80 | 100 |
| 1021 | 2243 | 105 | 124 |
| 1022 | 2136 | 11 | 30 |
| 1023 | 1878 | 11 | 31 |
| 1024 | 2182 | 11 | 31 |
| 1025 | 1891 | 77 | 96 |
| 1026 | 1924 | 140 | 160 |
| 1027 | 2341 | 255 | 275 |
| 1028 | 2244 | 147 | 167 |
| 1028 | 2556 | 142 | 162 |
| 1028 | 2663 | 114 | 134 |
| 1029 | 1756 | 225 | 244 |
| 1029 | 2329 | 195 | 214 |
| 1030 | 1856 | 11 | 31 |
| 1031 | 1808 | 139 | 159 |
| 1032 | 1873 | 57 | 76 |
| 1033 | 1993 | 72 | 92 |
| 1034 | 1696 | 55 | 78 |
| 1035 | 1912 | 33 | 53 |
| 1035 | 1990 | 33 | 53 |
| 1035 | 2500 | 33 | 53 |
| 1035 | 2664 | 33 | 53 |

TABLE 2

Maize miRNAs

| sRNA ID | SEQ ID NO. | Homolog* | Predicted in Corn Kernel | Predicted in Corn Leaf |
|---|---|---|---|---|
| 15996 | 3 | ptc-miR390c | y | y |
| 19644 | 4 | osa-miR396e | y | y |
| 25372 | 7 | ptc-miR172f | y | y |
| 35979 | 9 | ath-miR167d | y | y |
| 36116 | 10 | osa-miR528 | y | y |
| 56811 | 133 | ptc-miR396e | n | y |
| 59250 | 16 | ptc-miR398c | y | y |
| 432006 | 138 | sbi-miR164c | y | y |
| 1392730 | 32 | ath-miR171a | y | n |

*"ptc", *Populus trichocarpa*; "osa", *Oryza sativa*; "ath", *Arabidopsis thaliana*; "sbi", *Sorghum bicolor*

Example 2

Rice genes predicted to be targets of the novel rice miRNAs were predicted from The Institute for Genomic Research's rice genome annotation version 4.0 (publicly available at www.tigr.org), based on sequence complementarity rules as described by Zhang (2005) *Nucleic Acids Res.*, 33:W701-704 and by Rhoades et al. (2002) *Cell*, 110:513-520. These predicted targets were sequences that included at least one miRNA recognition site recognized by a mature miRNA selected from SEQ ID NOS. 1-1035, SEQ ID NOS. 2730-3921, SEQ ID NOS. 5498-6683, SEQ ID NOS. 8409-8560, SEQ ID NO 8742, SEQ ID NO. 8744, SEQ ID NOS. 8812-8815, SEQ ID NO. 8845, and SEQ ID NO. 8850 or a mature miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741 SEQ ID NO. 8743, SEQ ID NO. 8800, and SEQ ID NOS. 8816-8819. Table 3 lists non-limiting examples of miRNA recognition sites (SEQ ID NOS. 2691-2729) that are recognized by a rice mature miRNA (SEQ ID NO. 197).

TABLE 3

Os_miRNA_60735 miRNA sequence UCCGUCCCAAAAUAUAGCCAC (SEQ ID NO. 197)

| Predicted rice target Locus name and annotation | miRNA recognition site | | | | |
|---|---|---|---|---|---|
| | Nucleotide position in locus | mRNA sequence corresponding to cDNA | SEQ ID NO. | Score | No. of mismatches |
| LOC_Os01g65130.1\|11971.m126 26\|pcDNA expressed protein | 1086-1106 | guugcuauauuuugggacgga | 2691 | 1 | 1 |
| LOC_Os11g37540.1\|11981.m075 99\|cDNA Serine/threonine-protein kinase Doa, putative, expressed | 1925-1945 | guugcuauauuuugggacgga | 2692 | 1 | 1 |
| LOC_Os08g36030.1\|11978.m075 92\|cDNA Plant viral-response family protein, expressed | 1126-1146 | auugcuauauuuugggacgga | 2693 | 1 | 2 |
| LOC_Os12g12470.2\|11982.m268 68\|cDNA NADP-dependent oxidoreductase P1, putative, expressed | 1095-1115 | guuguuauauuuugggacgga | 2694 | 1.5 | 2 |
| LOC_Os09g20410.1\|11979.m052 48\|cDNA hypothetical protein | 587-607 | guugcuauauuuugggaugga | 2695 | 1.5 | 2 |
| LOC_Os06g12790.3\|11976.m320 28\|cDNA RAC-like GTP binding protein ARAC10, putative, expressed | 3792-3812 | auuguuauauuuugggacgga | 2696 | 1.5 | 3 |
| LOC_Os11g24540.1\|11981.m063 80\|cDNA signal peptide peptidase family protein, expressed | 2004-2024 | auuguuauauuuugggacgga | 2697 | 1.5 | 3 |
| LOC_Os02g38750.1\|11972.m089 63\|cDNA hypothetical protein | 55-75 | augcuuauauuuugggacgga | 2698 | 1.5 | 3 |
| LOC_Os07g49480.2\|11977.m290 28\|cDNA expressed protein | 2531-2551 | auuguuauauuuugggacgga | 2699 | 1.5 | 3 |
| LOC_Os01g56640.1\|11971.m975 46\|cDNA transcription factor jumonji, putative, expressed | 660-680 | augauuauauuuugggacgga | 2700 | 1.5 | 3 |
| LOC_Os06g12790.2\|11976.m322 47\|cDNA RAC-like GTP binding protein ARAC10, putative, expressed | 1947-1967 | uuugcuauauuuugggaugga | 2701 | 1.5 | 3 |
| LOC_Os10g22560.1\|11980.m052 63\|cDNA POT family protein, expressed | 1954-1974 | uuugcuauauuuugggaugga | 2702 | 1.5 | 3 |
| LOC_Os06g30280.1\|11976.m075 72\|cDNA expressed protein | 1895-1915 | guugcuauauuauggggacgga | 2703 | 2 | 2 |
| LOC_Os03g14800.3\|11973.m069 17\|cDNA aminotransferase, classes I and II family protein, expressed | 1826-1846 | aaagcuauauuuugggacgga | 2704 | 2 | 3 |
| LOC_Os05g25430.1\|11975.m068 36\|cDNA protein kinase family protein, putative, expressed | 684-704 | guuguuauauuuugggaugga | 2705 | 2 | 3 |
| LOC_Os04g41229.2\|11974.m789 64\|cDNA Helix-loop-helix DNA-binding domain containing protein, expressed | 175-195 | guugcuauauuuuggcacgga | 2706 | 2.5 | 2 |
| LOC_Os01g06740.1\|11971.m073 04\|cDNA Ribosome inactivating protein, expressed | 1362-1382 | gcaguuauauuuugggacgga | 2707 | 2.5 | 3 |
| LOC_Os03g14800.2\|11973.m351 26\|cDNA aminotransferase, classes I and II family protein, expressed | 861-881 | augcuuacauuuugggacgga | 2708 | 2.5 | 4 |

TABLE 3-continued

Os_miRNA_60735 miRNA sequence UCCGUCCCAAAAUAUAGCCAC (SEQ ID NO. 197)

| Predicted rice target Locus name and annotation | miRNA recognition site | | | | |
|---|---|---|---|---|---|
| | Nucleotide position in locus | mRNA sequence corresponding to cDNA | SEQ ID NO. | Score | No. of mismatches |
| LOC_Os09g36100.1\|11979.m06560\|cDNA expressed protein | 1469-1489 | acaguuauauuuugggacgga | 2709 | 2.5 | 4 |
| LOC_Os10g40740.1\|11980.m06842\|cDNA Helix-loop-helix DNA-binding domain containing protein, expressed | 1049-1069 | auacuuauauuuugggacgga | 2710 | 2.5 | 4 |
| LOC_Os06g04970.1\|11976.m05226\|cDNA expressed protein | 989-1009 | auacuuauauuuugggacgga | 2711 | 2.5 | 4 |
| LOC_Os11g43760.1\|11981.m08211\|cDNA Lipase family protein | 2628-2648 | auacuuauauuuugggacgga | 2712 | 2.5 | 4 |
| LOC_Os12g11660.1\|11982.m05145\|cDNA expressed protein | 1479-1499 | guugauuauuuugggacgga | 2713 | 3 | 3 |
| LOC_Os01g64330.1\|11971.m42582\|cDNA expressed protein | 630-650 | guugguuauuuugggacgga | 2714 | 3 | 3 |
| LOC_Os07g04840.2\|11977.m29060\|cDNA Oxygen-evolving enhancer protein 2, chloroplast precursor, putative, expressed | 574-594 | guugcuauauucuaggacgga | 2715 | 3 | 3 |
| LOC_Os09g13440.2\|11979.m22062\|cDNA expressed protein | 2068-2088 | auugcuauauuuuggaaugga | 2716 | 3 | 4 |
| LOC_Os06g12790.1\|11976.m05995\|cDNA RAC-like GTP binding protein ARAC10, putative, expressed | 2271-2291 | auugcuauauuuuggaauga | 2717 | 3 | 4 |
| LOC_Os09g17730.1\|11979.m05031\|cDNA proton pump interactor, putative, expressed | 958-978 | uucccuauauuuagggacgga | 2718 | 3 | 4 |
| LOC_Os11g40390.1\|11981.m07885\|cDNA expressed protein | 1302-1322 | augcuauauuuuggaacgga | 2719 | 3 | 4 |
| LOC_Os11g39670.1\|11981.m07814\|cDNA seryl-tRNA synthetase family protein, expressed | 924-944 | auugcuauauuauaggacgga | 2720 | 3 | 4 |
| LOC_Os07g04840.1\|11977.m04951\|cDNA Oxygen-evolving enhancer protein 2, chloroplast precursor, putative, expressed | 4246-4266 | uugucuuuuuuugggacgga | 2721 | 3 | 4 |
| LOC_Os03g47960.1\|11973.m09809\|cDNA HECT-domain-containing protein, putative, expressed | 1125-1145 | uuugcuauauuuugagaugga | 2722 | 3 | 4 |
| LOC_Os01g60780.1\|11971.m12206\|cDNA integral membrane protein, putative, expressed | 3110-3130 | ugcgauauauuuugggacgga | 2723 | 3 | 4 |
| LOC_Os10g01820.1\|11980.m21747\|cDNA expressed protein | 711-731 | augcuauauuuugagacgga | 2724 | 3 | 4 |
| LOC_Os06g48030.3\|11976.m32166\|cDNA Peroxidase 16 precursor, putative, expressed | 1475-1495 | cuguauuuauuuugggacgga | 2725 | 3 | 4 |
| LOC_Os02g02980.1\|11972.m05648\|cDNA Enhanced disease susceptibility 5, putative, expressed | 1357-1377 | uuggcugaauuuggggcgga | 2726 | 3 | 5 |

TABLE 3-continued

Os_miRNA_60735 miRNA sequence UCCGUCCCAAAAUAUAGCCAC (SEQ ID NO. 197)

| | | miRNA recognition site | | | |
|---|---|---|---|---|---|
| Predicted rice target Locus name and annotation | Nucleotide position in locus | mRNA sequence corresponding to cDNA | SEQ ID NO. | Score | No. of mismatches |
| LOC_Os08g32170.1\|11978.m072 11\|cDNA oxidoreductase, 2OG-Fe oxygenase family protein, expressed | 1297-1317 | uuggcugaauuuggggcgga | 2727 | 3 | 5 |
| LOC_Os11g39670.2\|11981.m288 46\|cDNA seryl-tRNA synthetase family protein, expressed | 114-134 | guggcuuuauugugggguggu | 2728 | 3 | 5 |
| LOC_Os08g25010.1\|11978.m065 20\|cDNA TBC domain containing protein, expressed | 367-387 | cugguuaaauugugggaugga | 2729 | 3 | 5 |

Example 3

This example describes non-limiting embodiments of recombinant DNA construct wherein the at least one transcribable DNA element for modulating the expression of at least one target gene includes a DNA element for suppressing expression of an endogenous miRNA derived from a plant miRNA precursor sequence selected from SEQ ID NOS. 1036-2690, SEQ ID NOS. 3922-5497, SEQ ID NOS. 6684-8408, SEQ ID NOS. 8561-8741, SEQ ID NO. 8743, SEQ ID NO. 8800, and SEQ ID NOS. 8816-8819. More specifically, this example illustrates non-limiting examples of DNA elements for suppressing expression of a target gene, e.g., an endogenous miRNA or an endogenous miRNA decoy sequence.

FIG. 2A schematically depicts non-limiting examples of DNA elements for suppressing expression of a target gene, e.g., an endogenous miRNA. These DNA elements include at least one first gene suppression element ("GSE" or "GSE1") for suppressing at least one first target gene, wherein the first gene suppression element is embedded in an intron flanked on one or on both sides by non-protein-coding DNA. These DNA elements utilize an intron (in many embodiments, an intron derived from a 5' untranslated region or an expression-enhancing intron is preferred) to deliver a gene suppression element without requiring the presence of any protein-coding exons (coding sequence). The DNA elements can optionally include at least one second gene suppression element ("GSE2") for suppressing at least one second target gene, at least one gene expression element ("GEE") for expressing at least one gene of interest (which can be coding or non-coding sequence or both), or both. In embodiments containing an optional gene expression element, the gene expression element can be located outside of (e.g., adjacent to) the intron. In some embodiments, the intron containing the first gene suppression element is 3' to a terminator.

To more clearly differentiate DNA elements of the invention (containing at least one gene suppression element embedded within a single intron flanked on one or on both sides by non-protein-coding DNA) from the prior art, FIG. 2B schematically depicts examples of prior art recombinant DNA constructs. These constructs can contain a gene suppression element that is located adjacent to an intron flanked by protein-coding sequence, or between two discrete introns (wherein the gene suppression element is not embedded in either of the two discrete introns), or can include a gene expression element including a gene suppression element embedded within an intron which is flanked by multiple exons (e.g., exons including the coding sequence of a protein).

FIG. 3 depicts various non-limiting examples of DNA elements for suppressing expression of a target gene, e.g., an endogenous miRNA, useful in the recombinant DNA constructs of the invention. Where drawn as a single strand (FIGS. 3A through 3E), these are conventionally depicted in 5' to 3' (left to right) transcriptional direction; the arrows indicate anti-sense sequence (arrowhead pointing to the left), or sense sequence (arrowhead pointing to the right). These DNA elements can include: DNA that includes at least one anti-sense DNA segment that is anti-sense to at least one segment of the at least one first target gene, or DNA that includes multiple copies of at least one anti-sense DNA segment that is anti-sense to at least one segment of the at least one first target gene (FIG. 3A); DNA that includes at least one sense DNA segment that is at least one segment of the at least one first target gene, or DNA that includes multiple copies of at least one sense DNA segment that is at least one segment of the at least one first target gene (FIG. 3B); DNA that transcribes to RNA for suppressing the at least one first target gene by forming double-stranded RNA and includes at least one anti-sense DNA segment that is anti-sense to at least one segment of the at least one target gene and at least one sense DNA segment that is at least one segment of the at least one first target gene (FIG. 3C); DNA that transcribes to RNA for suppressing the at least one first target gene by forming a single double-stranded RNA and includes multiple serial anti-sense DNA segments that are anti-sense to at least one segment of the at least one first target gene and multiple serial sense DNA segments that are at least one segment of the at least one first target gene (FIG. 3D); DNA that transcribes to RNA for suppressing the at least one first target gene by forming multiple double strands of RNA and includes multiple anti-sense DNA segments that are anti-sense to at least one segment of the at least one first target gene and multiple sense DNA segments that are at least one segment of the at least one first target gene, and wherein said multiple anti-sense DNA segments and the multiple sense DNA segments are arranged in a series of inverted repeats (FIG. 3E); and DNA that includes nucleotides derived from a miRNA, or DNA that includes nucleotides of a siRNA (FIG. 3F).

FIG. 3F depicts various non-limiting arrangements of double-stranded RNA that can be transcribed from embodiments of DNA elements for suppressing expression of a target gene, e.g., an endogenous miRNA, useful in the recombinant DNA constructs of the invention. When such double-stranded RNA is formed, it can suppress one or more target genes, and can form a single double-stranded RNA or multiple double strands of RNA, or a single double-stranded RNA "stem" or multiple "stems". Where multiple double-stranded RNA "stems" are formed, they can be arranged in "hammerheads" or "cloverleaf" arrangements. In some embodiments, the double-stranded stems can form a "pseudoknot" arrangement (e.g., where spacer or loop RNA of one double-stranded stem forms part of a second double-stranded stem); see, for example, depictions of pseudoknot architectures in Staple and Butcher (2005) *PLoS Biol.*, 3(6):e213. Spacer DNA (located between or adjacent to dsRNA regions) is optional but commonly included and generally includes DNA that does not correspond to the target gene (although in some embodiments can include sense or anti-sense DNA of the target gene). Spacer DNA can include sequence that transcribes to single-stranded RNA or to at least partially double-stranded RNA (such as in a "kissing stem-loop" arrangement), or to an RNA that assumes a secondary structure or three-dimensional configuration (e.g., a large loop of antisense sequence of the target gene or an aptamer) that confers on the transcript an additional desired characteristic, such as increased stability, increased half-life in vivo, or cell or tissue specificity.

Additional description of DNA elements and methods for suppressing expression of a target gene can be found, for example, in U.S. Patent Application Publication 2006/0200878, which is incorporated by reference herein.

Example 4

This example describes non-limiting embodiments of methods for using microRNAs, microRNA precursors, microRNA recognition sites, and microRNA promoters for modulating the expression of at least one target gene.

Various potential utilities of a miRNA or its recognition site are revealed by the miRNA's expression pattern. Knowledge of the spatial or temporal distribution or inducibility of a given mature miRNA's expression is useful, e.g., in designing recombinant constructs to be expressed in a spatially or temporally or inducibly specific manner. One non-limiting method of determining a mature miRNA's expression pattern is by isolation of the mature miRNA (or its precursor) and analyzing the expression pattern by Northern blots with the appropriate probe (i.e., probes specific for the mature miRNA or for the miRNA precursor).

Figure 4:
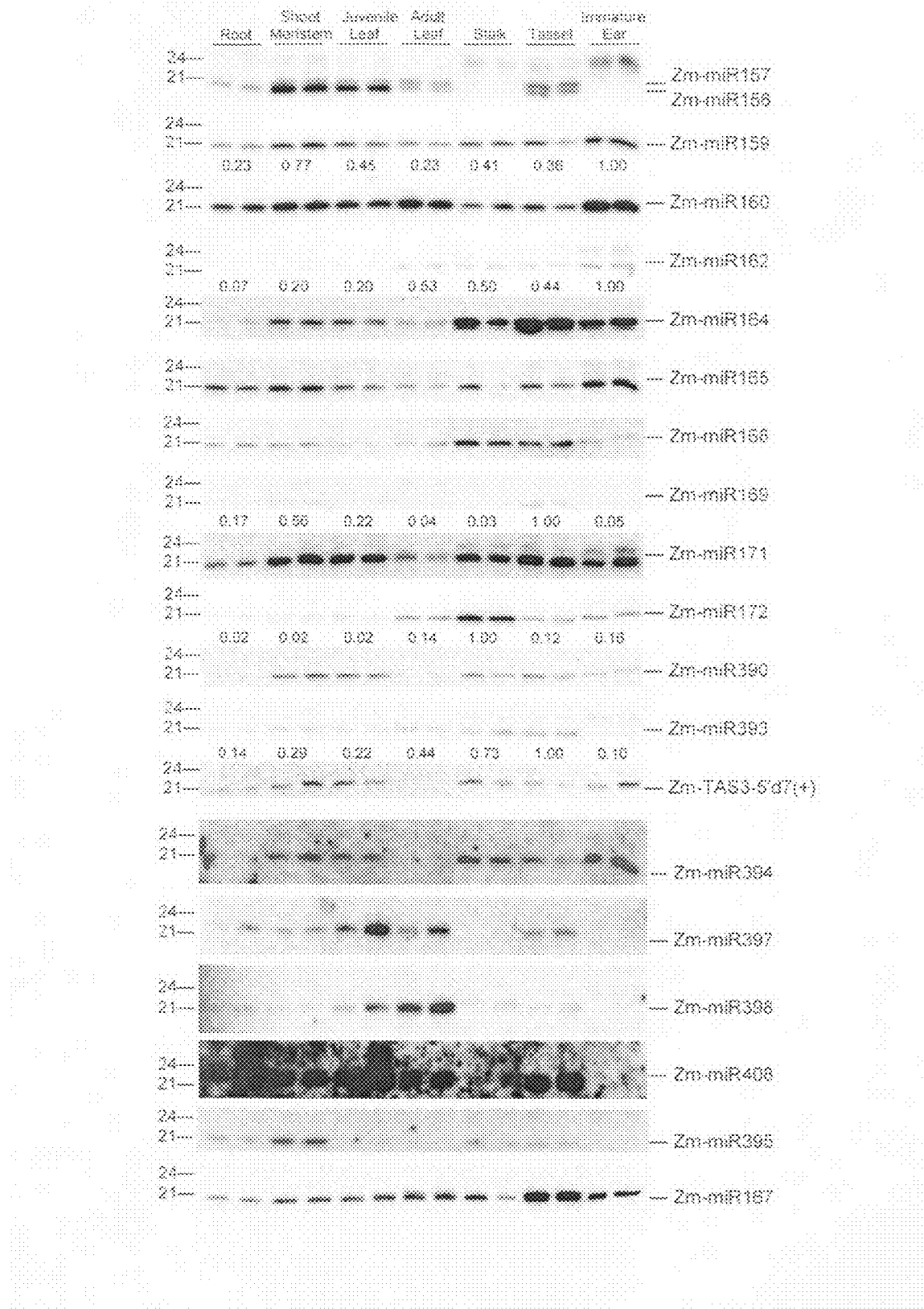
FIG. 4 depicts Northern blot results for mature miRNAs isolated from different maize tissues, as described in Example 4.

FIG. 4 depicts a non-limiting example of Northern blot results for mature miRNAs isolated from different maize tissues. One probe hybridized to mature miRNAs from two families (miR156 and miR157). Individual mature miRNAs were expressed at differing levels in specific cells or tissues, e.g., Zm-miR390 was not expressed, or expressed only at low levels, in root and adult leaf, and miR156 is expressed in roots, leaves, and tassel. Thus, for example, recombinant DNA construct of this invention including a transgene transcription unit driven by a constitutive promoter and a miRNA recognition site recognized by a maize miR390 mature miRNA is useful for expression of the transgene in root and adult leaf tissues but not in tissues where the mature miR390 is expressed at high levels. To further illustrate use of the constructs and methods of the invention to control expression of a transgene, a reporter gene is used as the transgene itself, or as a surrogate for the transgene. For example, where expression of a reporter gene (e.g., green fluorescent protein, GFP) is desired in maize stalk and immature ear tissue, a miR156 target site is included in a GFP expression cassette and expressed in a stably transgenic maize plant under the control of the CaMV 35S promoter. In tissues (e.g., roots, leaves, and tassel) where miR156 is strongly expressed, GFP expression is suppressed. The suppression phenotype may be limited to very specific cell types within the suppressed tissues, with neighboring cells showing expression or a gradient of expression of GFP adjacent to those cells expressing the mature miR156.

Another non-limiting method of determining a mature miRNA's expression pattern is by analyzing transcription profiles of nucleic acid sequences that include the mature miRNA sequence, for example, by following a general procedure including the steps of:

(a) providing an initial miR sequence including the stem-loop region, e.g., from the publicly available miR sequences at the "miRBase" database (available on line at microrna.sanger.ac.uk/sequences);

(b) applying sequence analysis algorithms, such as BLAST as is well known in the art (see Altschul et al. (1990) *J. Mol. Biol.*, 215:403-410) to identify homologous or identical sequences (e.g., from proprietary sequences on microarray probesets made with corn whole genome DNA); and (c) analyzing the transcription profiles of the homologous probeset sequences identified in step (b) and identifying miRNAs having an expression pattern in the desired tissues (i.e., male or female reproductive tissues).

Preferably, a fourth step is added:

(d) for homologous probeset sequences found to have the desired transcription profiles, confirming identification of the miRNA gene by either aligning the stem-loop sequence of the initial miR sequence to the probeset sequence, or for potentially novel miRNAs, determining the sequence is predicted to fold into a stem-loop structure characteristic of a miRNA. Also preferably, an optional step is used, wherein one or more BLAST comparisons against additional sequence datasets other than the probeset sequence dataset is included (prior to step (b) above), allowing the further identification of probes that fall outside of the predicted fold-back region of the miR gene; false positives, e.g., due to matches in the additional sequence dataset(s) that include incorrectly spliced contigs, are identified by their lack of miRNA characteristics such as proper fold-back structure, and removed.

Figure 5:
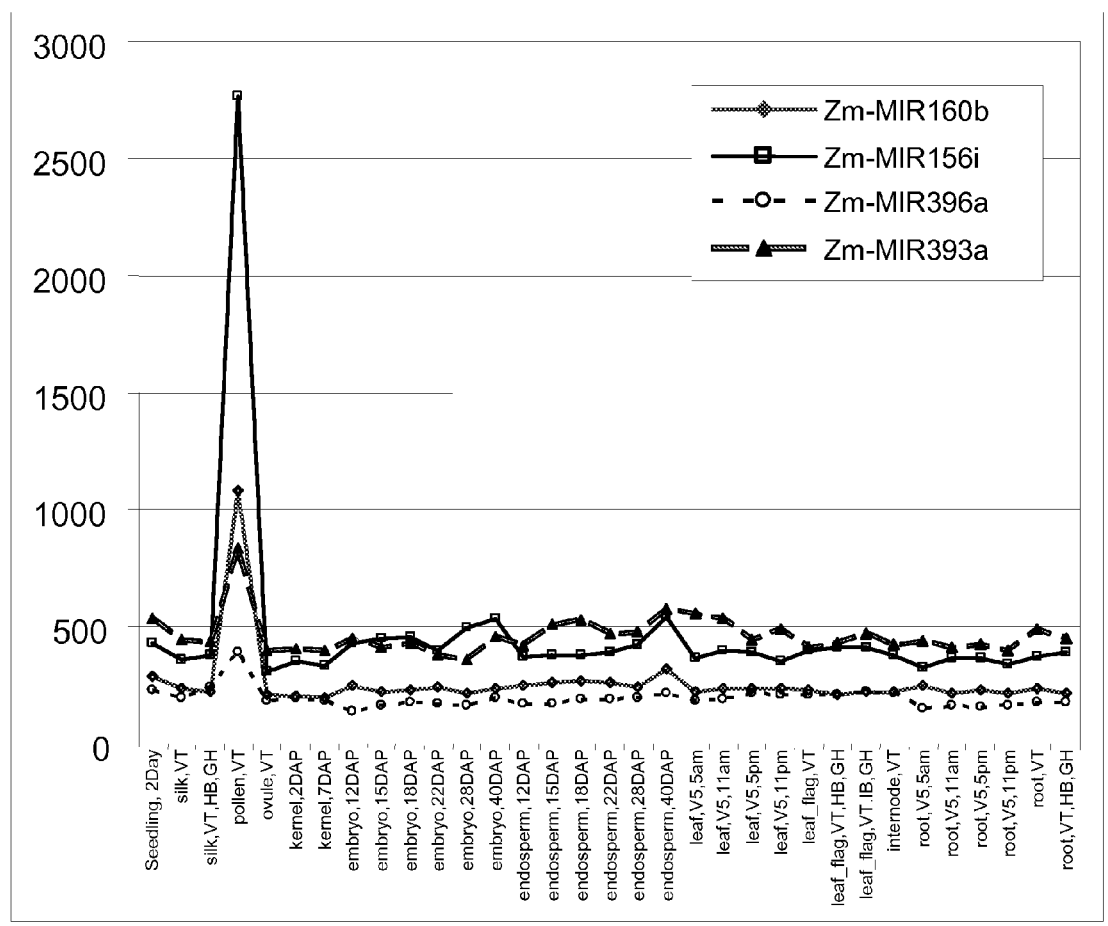
FIG. 5 depicts transcription profiles of probeset sequences including miRNA precursor sequences having expression patterns specific to maize male reproductive tissue (pollen), as described in Example 4.

FIG. 5 depicts transcription profiles of probeset sequences that were identified, using the procedure described in the preceding paragraphs, as including miRNA precursor sequences having expression patterns specific to maize male reproductive tissue (pollen). Such miRNA precursors are suitable for use in recombinant DNA constructs of this invention designed for expression of a native miRNA (in this example, a pollen-specific miRNA) under non-native conditions (e.g., under the control of a promoter other than the promoter native to the miRNA precursor). These miRNA precursors are also useful for providing a "scaffold" sequence that can be modified or engineered to suppress a target gene other than the native or endogenous target gene. One non-limiting example of a recombinant DNA construct of this invention includes a strong constitutive promoter that is used to drive expression of transgene transcription unit encoding a *Bacillus thuringiensis* insecticidal protein or protein fragment ("Bt"), and a recognition site for a pollen-specific miRNA, resulting in strong Bt expression in tissues of the plant except for the pollen. Additionally, the native promoters of these miRNA precursors are useful for pollen-specific expression of any gene of interest.

In an alternative approach, an existing (native or endogenous) miRNA recognition site is identified, for example, using sequence complementarity rules as described by Zhang (2005) *Nucleic Acids Res.*, 33:W701-704 and by Rhoades et al. (2002) *Cell*, 110:513-520. The native miRNA recognition site is mutated (e.g., by chemical mutagenesis) sufficiently to reduce or prevent cleavage (see Mallory et al. (2004) *Curr. Biol.*, 14:1035-1046). In this way a gene containing a native miRNA recognition site and having desirable effects, e.g., increased leaf or seed size, can be mutated and thus expressed at levels higher than when the unmutated native or endogenous miRNA recognition site was present. One embodiment is to replace a native gene with an engineered homologue, wherein a native miRNA has been mutated or even deleted, that is less susceptible to cleavage by a given miRNA.

Another specific example of this approach is the inclusion of one or more recognition site for a mature miRNA not substantially expressed in maize roots but expressed in most other tissues (such as, but not limited to, miRNA162, miRNA164, or miRNA390 as depicted in FIG. 4) in a recombinant DNA construct for the expression of a *Bacillus thuringiensis* insecticidal protein or protein fragment ("Bt", see, for example, the *B. thuringiensis* insecticidal sequences and methods of use thereof disclosed in U.S. Pat. No. 6,953,835 and in U.S. Provisional Patent Application No. 60/713,111, filed on 31 Aug. 2005, which are incorporated by reference herein) as the transgene, e.g., in a construct including the expression cassette e35S/Bt/hsp17. Including one or more of these recognition sites within the expression cassette reduces the expression of transcripts in most tissues other than root, but maintains high Bt target RNA expression levels in roots, such as is desirable for control of pests such as corn rootworm. In similar embodiments, combinations of different miRNA recognition sites are included in the construct to achieve the desired expression pattern in one or more specific tissues.

Example 5

This example describes additional non-limiting embodiments of crop plant microRNAs and their precursor (foldback) structures, useful in making recombinant DNA constructs of this invention. A total of 1327933 unique small RNAs (20 to 24 nucleotides long) were obtained by high-throughput sequencing of 30 corn (maize) libraries (Margulies et al. (2005) *Nature*, 437:376-380). The sequences obtained were used for predicting corn microRNAs and their precursor structures from maize genomic sequences using the procedures described above in Example 1. In total, 1192 small RNAs in 1576 proprietary maize genomic sequences were predicted to be new miRNAs. The corn miRNAs and their corresponding miRNA precursors, as well as the nucleotide position of the mature miRNA in each miRNA precursor sequence, are referred to by their respective sequence identification numbers in Table 4 as follows: corn miRNAs (SEQ ID NOS. 2730-3921) and corn miRNA precursor sequences (SEQ ID NOS. 3922-5497).

TABLE 4

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 2730 | 3928 | 84 | 104 |
| 2731 | 4099 | 92 | 113 |
| 2732 | 3935 | 11 | 31 |

TABLE 4-continued

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 2733 | 4093 | 11 | 31 |
| 2734 | 5134 | 11 | 32 |
| 2735 | 4864 | 188 | 211 |
| 2736 | 4123 | 11 | 30 |
| 2737 | 4108 | 4 | 27 |
| 2738 | 5217 | 11 | 33 |
| 2738 | 5277 | 11 | 33 |
| 2739 | 4328 | 71 | 90 |
| 2740 | 4635 | 42 | 62 |
| 2741 | 4591 | 11 | 34 |
| 2742 | 3925 | 11 | 34 |
| 2743 | 4036 | 11 | 34 |
| 2744 | 4586 | 11 | 32 |
| 2745 | 5245 | 37 | 57 |
| 2746 | 5417 | 30 | 53 |
| 2747 | 4527 | 171 | 190 |
| 2748 | 5486 | 11 | 32 |
| 2749 | 4440 | 11 | 32 |
| 2749 | 4428 | 11 | 32 |
| 2750 | 5469 | 241 | 261 |
| 2751 | 5066 | 11 | 30 |
| 2752 | 5095 | 61 | 82 |
| 2753 | 4468 | 113 | 133 |
| 2754 | 4924 | 37 | 59 |
| 2755 | 5242 | 11 | 30 |
| 2756 | 5292 | 83 | 103 |
| 2757 | 3959 | 11 | 33 |
| 2758 | 5489 | 150 | 171 |
| 2759 | 3929 | 11 | 34 |
| 2760 | 5153 | 11 | 30 |
| 2761 | 4251 | 11 | 34 |
| 2762 | 5361 | 35 | 55 |
| 2763 | 3995 | 11 | 34 |
| 2764 | 4448 | 11 | 30 |
| 2764 | 4473 | 11 | 30 |
| 2765 | 4784 | 11 | 30 |
| 2766 | 4478 | 63 | 83 |
| 2767 | 4477 | 11 | 34 |
| 2768 | 4275 | 11 | 33 |
| 2768 | 4223 | 11 | 33 |
| 2769 | 5084 | 11 | 31 |
| 2769 | 5063 | 61 | 81 |
| 2770 | 3985 | 11 | 34 |
| 2771 | 5384 | 11 | 32 |
| 2772 | 4053 | 11 | 34 |
| 2772 | 4058 | 113 | 136 |
| 2772 | 4057 | 113 | 136 |
| 2772 | 4059 | 11 | 34 |
| 2772 | 4051 | 104 | 127 |
| 2772 | 4056 | 11 | 34 |
| 2773 | 4215 | 11 | 34 |
| 2774 | 4718 | 215 | 237 |
| 2775 | 5098 | 37 | 56 |
| 2776 | 5011 | 11 | 30 |
| 2777 | 5262 | 62 | 82 |
| 2778 | 5022 | 11 | 30 |
| 2779 | 5369 | 47 | 66 |
| 2780 | 5038 | 11 | 34 |
| 2781 | 3974 | 1 | 24 |
| 2782 | 4933 | 103 | 124 |
| 2783 | 4380 | 89 | 109 |
| 2784 | 4752 | 11 | 33 |
| 2785 | 4341 | 209 | 232 |
| 2786 | 5408 | 11 | 31 |
| 2786 | 5356 | 11 | 31 |
| 2787 | 5048 | 37 | 57 |
| 2788 | 4920 | 153 | 174 |
| 2789 | 5366 | 35 | 55 |
| 2790 | 4159 | 203 | 222 |
| 2791 | 4798 | 44 | 67 |
| 2792 | 4530 | 11 | 31 |
| 2793 | 5269 | 11 | 31 |
| 2794 | 4334 | 6 | 29 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 2795 | 5287 | 11 | 30 |
| 2796 | 5362 | 11 | 30 |
| 2796 | 5396 | 11 | 30 |
| 2796 | 5344 | 11 | 30 |
| 2796 | 5310 | 11 | 30 |
| 2796 | 5360 | 11 | 30 |
| 2797 | 5440 | 118 | 138 |
| 2797 | 5456 | 118 | 138 |
| 2798 | 4962 | 70 | 93 |
| 2799 | 4522 | 11 | 34 |
| 2800 | 4286 | 11 | 34 |
| 2801 | 4299 | 11 | 30 |
| 2801 | 4235 | 11 | 30 |
| 2802 | 4103 | 11 | 32 |
| 2803 | 5136 | 37 | 58 |
| 2803 | 5208 | 37 | 58 |
| 2804 | 4894 | 11 | 31 |
| 2805 | 4413 | 11 | 30 |
| 2806 | 4807 | 11 | 34 |
| 2807 | 4844 | 426 | 449 |
| 2808 | 4022 | 118 | 141 |
| 2809 | 5312 | 11 | 30 |
| 2810 | 4270 | 52 | 71 |
| 2811 | 4233 | 8 | 30 |
| 2811 | 4244 | 253 | 275 |
| 2811 | 4293 | 75 | 97 |
| 2812 | 4517 | 55 | 77 |
| 2813 | 4456 | 40 | 59 |
| 2814 | 4258 | 87 | 107 |
| 2815 | 5276 | 242 | 261 |
| 2816 | 4638 | 54 | 77 |
| 2816 | 4815 | 54 | 77 |
| 2817 | 4378 | 11 | 34 |
| 2818 | 5298 | 33 | 54 |
| 2819 | 4208 | 11 | 30 |
| 2820 | 4187 | 11 | 30 |
| 2820 | 4176 | 11 | 30 |
| 2821 | 5333 | 103 | 123 |
| 2822 | 4958 | 11 | 31 |
| 2823 | 4500 | 11 | 34 |
| 2824 | 4373 | 11 | 34 |
| 2825 | 4024 | 11 | 34 |
| 2826 | 5407 | 47 | 67 |
| 2826 | 5448 | 11 | 31 |
| 2827 | 5479 | 230 | 253 |
| 2828 | 4201 | 53 | 72 |
| 2829 | 4709 | 204 | 224 |
| 2830 | 4525 | 141 | 160 |
| 2831 | 4876 | 125 | 147 |
| 2832 | 4122 | 11 | 31 |
| 2833 | 4060 | 109 | 132 |
| 2833 | 4055 | 11 | 34 |
| 2834 | 5302 | 74 | 94 |
| 2835 | 5308 | 60 | 79 |
| 2836 | 4238 | 75 | 95 |
| 2837 | 5119 | 11 | 32 |
| 2838 | 4873 | 83 | 103 |
| 2839 | 4947 | 11 | 30 |
| 2840 | 4791 | 231 | 253 |
| 2841 | 4567 | 11 | 33 |
| 2842 | 5463 | 11 | 33 |
| 2843 | 4957 | 42 | 62 |
| 2844 | 5205 | 38 | 61 |
| 2845 | 4239 | 65 | 85 |
| 2846 | 5059 | 149 | 169 |
| 2847 | 3964 | 79 | 102 |
| 2848 | 4516 | 48 | 71 |
| 2849 | 4121 | 11 | 32 |
| 2850 | 4526 | 72 | 95 |
| 2851 | 4659 | 11 | 30 |
| 2851 | 4670 | 11 | 30 |
| 2851 | 4668 | 11 | 30 |
| 2852 | 4206 | 616 | 636 |
| 2853 | 5331 | 443 | 465 |
| 2854 | 4726 | 11 | 34 |
| 2855 | 4606 | 11 | 34 |
| 2855 | 4729 | 11 | 34 |
| 2855 | 4565 | 11 | 34 |
| 2856 | 4684 | 11 | 33 |
| 2857 | 4660 | 11 | 34 |
| 2858 | 5284 | 92 | 115 |
| 2859 | 5354 | 60 | 83 |
| 2859 | 5395 | 61 | 84 |
| 2859 | 5336 | 11 | 34 |
| 2859 | 5394 | 11 | 34 |
| 2859 | 5430 | 11 | 34 |
| 2859 | 5449 | 11 | 34 |
| 2859 | 5355 | 11 | 34 |
| 2859 | 5444 | 226 | 249 |
| 2860 | 5070 | 56 | 77 |
| 2860 | 5077 | 11 | 32 |
| 2861 | 4086 | 111 | 134 |
| 2861 | 4089 | 11 | 34 |
| 2862 | 4461 | 298 | 321 |
| 2863 | 4663 | 54 | 75 |
| 2864 | 4878 | 37 | 57 |
| 2865 | 4965 | 11 | 34 |
| 2866 | 4232 | 11 | 34 |
| 2867 | 4007 | 40 | 62 |
| 2868 | 4991 | 64 | 83 |
| 2869 | 5180 | 35 | 56 |
| 2870 | 4247 | 71 | 92 |
| 2871 | 4179 | 11 | 34 |
| 2872 | 5470 | 35 | 56 |
| 2873 | 3983 | 65 | 88 |
| 2874 | 4263 | 11 | 31 |
| 2875 | 5204 | 64 | 83 |
| 2876 | 4364 | 11 | 30 |
| 2877 | 5359 | 218 | 238 |
| 2878 | 4291 | 11 | 34 |
| 2879 | 4217 | 11 | 34 |
| 2880 | 4921 | 11 | 30 |
| 2881 | 4075 | 11 | 34 |
| 2881 | 4067 | 11 | 34 |
| 2882 | 4508 | 11 | 34 |
| 2883 | 5120 | 11 | 33 |
| 2884 | 4276 | 34 | 53 |
| 2884 | 4318 | 34 | 53 |
| 2885 | 4598 | 11 | 32 |
| 2886 | 5445 | 72 | 91 |
| 2887 | 4045 | 38 | 60 |
| 2888 | 5473 | 11 | 34 |
| 2888 | 5324 | 11 | 34 |
| 2889 | 4030 | 11 | 33 |
| 2889 | 5363 | 116 | 138 |
| 2889 | 4039 | 11 | 33 |
| 2889 | 4035 | 11 | 33 |
| 2889 | 4029 | 106 | 128 |
| 2889 | 4031 | 11 | 33 |
| 2889 | 4032 | 11 | 33 |
| 2890 | 4174 | 11 | 34 |
| 2891 | 5271 | 35 | 58 |
| 2891 | 5109 | 36 | 59 |
| 2891 | 5163 | 35 | 58 |
| 2891 | 5159 | 35 | 58 |
| 2892 | 4578 | 11 | 34 |
| 2892 | 4774 | 11 | 34 |
| 2893 | 3934 | 155 | 178 |
| 2893 | 3923 | 11 | 34 |
| 2894 | 4504 | 11 | 31 |
| 2895 | 5196 | 60 | 80 |
| 2896 | 4863 | 11 | 33 |
| 2897 | 3953 | 11 | 34 |
| 2897 | 3967 | 46 | 69 |
| 2897 | 3955 | 11 | 34 |
| 2897 | 3949 | 49 | 72 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 2898 | 5397 | 11 | 32 |
| 2898 | 5392 | 11 | 32 |
| 2899 | 4383 | 36 | 59 |
| 2900 | 5240 | 36 | 59 |
| 2901 | 5005 | 58 | 80 |
| 2901 | 4880 | 58 | 80 |
| 2902 | 4750 | 11 | 32 |
| 2903 | 4279 | 11 | 34 |
| 2904 | 4230 | 229 | 248 |
| 2905 | 4955 | 39 | 59 |
| 2906 | 4736 | 51 | 70 |
| 2906 | 4605 | 51 | 70 |
| 2907 | 5379 | 138 | 158 |
| 2908 | 5435 | 11 | 32 |
| 2909 | 5127 | 11 | 31 |
| 2910 | 5368 | 11 | 31 |
| 2911 | 4877 | 11 | 34 |
| 2912 | 5023 | 50 | 73 |
| 2913 | 4087 | 11 | 32 |
| 2914 | 5303 | 174 | 193 |
| 2915 | 5461 | 54 | 77 |
| 2916 | 4789 | 44 | 63 |
| 2917 | 3937 | 11 | 34 |
| 2918 | 4218 | 135 | 158 |
| 2919 | 5040 | 119 | 139 |
| 2920 | 5147 | 11 | 34 |
| 2921 | 5329 | 54 | 77 |
| 2922 | 4135 | 67 | 86 |
| 2923 | 4981 | 122 | 141 |
| 2924 | 5071 | 11 | 32 |
| 2925 | 4620 | 45 | 65 |
| 2926 | 4008 | 11 | 34 |
| 2927 | 3994 | 252 | 275 |
| 2928 | 4280 | 11 | 34 |
| 2929 | 4142 | 77 | 97 |
| 2930 | 4982 | 11 | 30 |
| 2931 | 4917 | 4 | 27 |
| 2932 | 4126 | 106 | 128 |
| 2933 | 3945 | 202 | 222 |
| 2934 | 4269 | 11 | 32 |
| 2935 | 4483 | 154 | 177 |
| 2936 | 5393 | 46 | 69 |
| 2937 | 4319 | 186 | 208 |
| 2938 | 4080 | 69 | 92 |
| 2939 | 4918 | 11 | 33 |
| 2940 | 4499 | 11 | 30 |
| 2941 | 4327 | 304 | 323 |
| 2942 | 5146 | 121 | 144 |
| 2943 | 5106 | 208 | 228 |
| 2944 | 4680 | 11 | 30 |
| 2945 | 4209 | 11 | 34 |
| 2946 | 5453 | 132 | 151 |
| 2947 | 4166 | 137 | 157 |
| 2948 | 5386 | 11 | 32 |
| 2949 | 5199 | 11 | 32 |
| 2950 | 4969 | 44 | 63 |
| 2951 | 5033 | 179 | 199 |
| 2951 | 5091 | 180 | 200 |
| 2952 | 4063 | 11 | 34 |
| 2953 | 5232 | 138 | 158 |
| 2954 | 5494 | 11 | 31 |
| 2955 | 4972 | 11 | 30 |
| 2956 | 5008 | 245 | 268 |
| 2957 | 4111 | 6 | 26 |
| 2958 | 4501 | 37 | 56 |
| 2959 | 5349 | 11 | 34 |
| 2960 | 3971 | 11 | 31 |
| 2960 | 3956 | 217 | 237 |
| 2960 | 3963 | 92 | 112 |
| 2961 | 4044 | 54 | 76 |
| 2962 | 5050 | 11 | 33 |
| 2963 | 4421 | 116 | 138 |
| 2964 | 4083 | 200 | 219 |
| 2965 | 4566 | 11 | 32 |
| 2966 | 4193 | 11 | 34 |
| 2967 | 5376 | 62 | 85 |
| 2968 | 4787 | 31 | 50 |
| 2968 | 4759 | 31 | 50 |
| 2969 | 4333 | 53 | 72 |
| 2969 | 4385 | 53 | 72 |
| 2970 | 4391 | 11 | 32 |
| 2971 | 4537 | 11 | 30 |
| 2972 | 5317 | 133 | 153 |
| 2972 | 5318 | 136 | 156 |
| 2972 | 5446 | 62 | 82 |
| 2972 | 5380 | 136 | 156 |
| 2972 | 5471 | 162 | 182 |
| 2972 | 5452 | 136 | 156 |
| 2972 | 5341 | 140 | 160 |
| 2972 | 5460 | 11 | 31 |
| 2972 | 5374 | 11 | 31 |
| 2972 | 5451 | 137 | 157 |
| 2973 | 4084 | 11 | 34 |
| 2974 | 4116 | 41 | 60 |
| 2975 | 5468 | 11 | 31 |
| 2976 | 4474 | 11 | 34 |
| 2977 | 4744 | 11 | 34 |
| 2978 | 4447 | 11 | 34 |
| 2979 | 4738 | 11 | 30 |
| 2980 | 4132 | 11 | 34 |
| 2981 | 4505 | 11 | 30 |
| 2982 | 5124 | 11 | 33 |
| 2983 | 4888 | 35 | 58 |
| 2984 | 4558 | 11 | 34 |
| 2985 | 4449 | 41 | 60 |
| 2986 | 5410 | 116 | 136 |
| 2987 | 5030 | 11 | 34 |
| 2988 | 4767 | 11 | 30 |
| 2988 | 4633 | 11 | 30 |
| 2989 | 5288 | 35 | 56 |
| 2990 | 4101 | 245 | 266 |
| 2991 | 5178 | 11 | 32 |
| 2991 | 5198 | 8 | 29 |
| 2991 | 5275 | 11 | 32 |
| 2991 | 5185 | 11 | 32 |
| 2991 | 5160 | 11 | 32 |
| 2992 | 4097 | 11 | 34 |
| 2993 | 4656 | 11 | 31 |
| 2994 | 4514 | 219 | 241 |
| 2994 | 4398 | 219 | 241 |
| 2995 | 5437 | 11 | 34 |
| 2996 | 4117 | 39 | 58 |
| 2997 | 4446 | 11 | 31 |
| 2998 | 5421 | 6 | 27 |
| 2999 | 4259 | 11 | 30 |
| 3000 | 5423 | 11 | 31 |
| 3001 | 4948 | 101 | 121 |
| 3002 | 5268 | 11 | 31 |
| 3003 | 4285 | 11 | 34 |
| 3004 | 5351 | 11 | 32 |
| 3005 | 5477 | 49 | 69 |
| 3006 | 5237 | 11 | 34 |
| 3006 | 5219 | 11 | 34 |
| 3006 | 5238 | 11 | 34 |
| 3007 | 4246 | 11 | 31 |
| 3008 | 4466 | 41 | 62 |
| 3009 | 3977 | 11 | 34 |
| 3009 | 3979 | 37 | 60 |
| 3009 | 3975 | 37 | 60 |
| 3009 | 3972 | 38 | 61 |
| 3010 | 5112 | 11 | 32 |
| 3011 | 4085 | 254 | 277 |
| 3012 | 5003 | 313 | 336 |
| 3013 | 4625 | 11 | 30 |
| 3014 | 5459 | 108 | 131 |
| 3015 | 5143 | 85 | 104 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3016 | 5334 | 34 | 57 |
| 3017 | 5482 | 11 | 30 |
| 3018 | 5326 | 139 | 161 |
| 3019 | 3941 | 69 | 92 |
| 3019 | 3938 | 69 | 92 |
| 3019 | 3943 | 69 | 92 |
| 3020 | 4682 | 11 | 30 |
| 3021 | 4214 | 115 | 138 |
| 3022 | 4691 | 11 | 32 |
| 3022 | 4753 | 11 | 32 |
| 3023 | 4717 | 11 | 30 |
| 3024 | 5018 | 78 | 97 |
| 3025 | 4776 | 11 | 31 |
| 3026 | 4105 | 11 | 34 |
| 3027 | 4115 | 11 | 30 |
| 3027 | 4167 | 173 | 192 |
| 3028 | 4892 | 640 | 659 |
| 3029 | 4154 | 11 | 32 |
| 3030 | 4749 | 11 | 32 |
| 3030 | 4783 | 11 | 32 |
| 3031 | 4611 | 179 | 200 |
| 3032 | 4721 | 11 | 34 |
| 3033 | 5365 | 118 | 138 |
| 3034 | 4705 | 112 | 131 |
| 3034 | 4570 | 113 | 132 |
| 3034 | 4827 | 104 | 123 |
| 3035 | 4714 | 42 | 63 |
| 3035 | 4829 | 11 | 32 |
| 3035 | 4733 | 43 | 64 |
| 3036 | 4617 | 11 | 33 |
| 3037 | 4847 | 126 | 146 |
| 3038 | 5130 | 11 | 31 |
| 3038 | 5223 | 11 | 31 |
| 3038 | 5156 | 11 | 31 |
| 3038 | 5248 | 11 | 31 |
| 3038 | 5183 | 11 | 31 |
| 3038 | 5278 | 11 | 31 |
| 3039 | 4314 | 60 | 80 |
| 3040 | 4502 | 113 | 136 |
| 3041 | 5327 | 117 | 140 |
| 3042 | 4363 | 11 | 31 |
| 3042 | 4503 | 11 | 31 |
| 3042 | 4388 | 107 | 127 |
| 3043 | 4370 | 39 | 59 |
| 3044 | 4151 | 138 | 161 |
| 3045 | 5170 | 11 | 30 |
| 3046 | 4061 | 11 | 34 |
| 3046 | 4073 | 11 | 34 |
| 3046 | 4070 | 11 | 34 |
| 3046 | 4065 | 11 | 34 |
| 3046 | 4062 | 102 | 125 |
| 3046 | 4064 | 11 | 34 |
| 3046 | 4076 | 11 | 34 |
| 3047 | 4546 | 11 | 33 |
| 3048 | 5311 | 118 | 137 |
| 3049 | 4204 | 11 | 31 |
| 3050 | 5370 | 11 | 34 |
| 3050 | 5357 | 49 | 72 |
| 3051 | 4671 | 11 | 32 |
| 3051 | 4716 | 11 | 32 |
| 3052 | 5346 | 102 | 123 |
| 3052 | 5465 | 102 | 123 |
| 3053 | 4409 | 59 | 80 |
| 3053 | 4467 | 59 | 80 |
| 3054 | 5001 | 59 | 82 |
| 3054 | 4853 | 60 | 83 |
| 3055 | 5429 | 39 | 61 |
| 3056 | 4518 | 6 | 26 |
| 3057 | 5062 | 11 | 34 |
| 3058 | 4207 | 155 | 174 |
| 3059 | 4492 | 11 | 34 |
| 3060 | 5224 | 50 | 73 |
| 3061 | 4047 | 97 | 120 |
| 3062 | 3984 | 1 | 24 |
| 3063 | 5385 | 50 | 73 |
| 3064 | 5090 | 58 | 77 |
| 3065 | 3940 | 11 | 30 |
| 3066 | 5353 | 36 | 56 |
| 3067 | 5358 | 11 | 34 |
| 3068 | 4697 | 206 | 226 |
| 3068 | 4674 | 207 | 227 |
| 3068 | 4560 | 206 | 226 |
| 3069 | 5258 | 11 | 34 |
| 3070 | 5188 | 44 | 67 |
| 3071 | 4054 | 43 | 66 |
| 3072 | 4542 | 38 | 60 |
| 3072 | 4742 | 38 | 60 |
| 3073 | 5260 | 11 | 30 |
| 3074 | 5434 | 213 | 234 |
| 3075 | 5381 | 11 | 30 |
| 3076 | 4312 | 94 | 117 |
| 3077 | 4874 | 11 | 34 |
| 3078 | 4930 | 89 | 108 |
| 3079 | 4139 | 11 | 34 |
| 3080 | 5174 | 94 | 116 |
| 3081 | 5121 | 120 | 139 |
| 3081 | 5184 | 121 | 140 |
| 3082 | 4722 | 11 | 34 |
| 3083 | 4836 | 11 | 30 |
| 3084 | 5193 | 11 | 34 |
| 3085 | 5315 | 115 | 138 |
| 3086 | 4664 | 172 | 195 |
| 3087 | 5162 | 11 | 31 |
| 3088 | 4914 | 70 | 89 |
| 3089 | 4110 | 220 | 243 |
| 3090 | 4102 | 11 | 34 |
| 3091 | 5279 | 11 | 34 |
| 3092 | 4141 | 193 | 216 |
| 3093 | 4869 | 11 | 34 |
| 3094 | 5135 | 11 | 30 |
| 3095 | 5041 | 56 | 79 |
| 3096 | 4553 | 42 | 63 |
| 3097 | 5020 | 37 | 58 |
| 3097 | 5017 | 37 | 58 |
| 3098 | 5442 | 174 | 194 |
| 3099 | 5382 | 74 | 94 |
| 3099 | 5330 | 11 | 31 |
| 3100 | 4495 | 11 | 34 |
| 3101 | 4253 | 75 | 96 |
| 3102 | 3944 | 41 | 64 |
| 3102 | 3942 | 11 | 34 |
| 3103 | 5073 | 58 | 77 |
| 3104 | 4137 | 142 | 163 |
| 3105 | 4066 | 11 | 31 |
| 3106 | 5028 | 70 | 90 |
| 3107 | 5267 | 105 | 128 |
| 3108 | 5169 | 11 | 33 |
| 3109 | 4543 | 165 | 184 |
| 3110 | 4702 | 11 | 31 |
| 3111 | 4313 | 11 | 34 |
| 3112 | 5132 | 140 | 159 |
| 3113 | 5404 | 4 | 24 |
| 3113 | 5398 | 4 | 24 |
| 3114 | 5116 | 11 | 34 |
| 3115 | 4818 | 11 | 31 |
| 3116 | 4026 | 48 | 71 |
| 3117 | 5141 | 136 | 159 |
| 3118 | 4420 | 11 | 30 |
| 3119 | 5013 | 11 | 30 |
| 3120 | 4336 | 11 | 30 |
| 3121 | 3999 | 34 | 53 |
| 3121 | 3998 | 34 | 53 |
| 3122 | 4631 | 37 | 58 |
| 3123 | 4127 | 11 | 30 |
| 3124 | 4180 | 11 | 31 |
| 3125 | 4104 | 11 | 34 |

TABLE 4-continued

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 3125 | 4106 | 11 | 34 |
| 3126 | 5047 | 11 | 31 |
| 3126 | 4908 | 11 | 31 |
| 3127 | 5350 | 38 | 59 |
| 3127 | 5457 | 38 | 59 |
| 3128 | 5467 | 41 | 61 |
| 3129 | 4602 | 11 | 31 |
| 3130 | 5348 | 70 | 90 |
| 3131 | 5034 | 11 | 31 |
| 3132 | 4773 | 43 | 62 |
| 3132 | 4614 | 51 | 70 |
| 3132 | 4687 | 51 | 70 |
| 3133 | 5026 | 8 | 28 |
| 3134 | 4376 | 11 | 33 |
| 3135 | 4748 | 66 | 87 |
| 3136 | 4402 | 160 | 180 |
| 3137 | 4379 | 188 | 208 |
| 3138 | 4779 | 115 | 135 |
| 3139 | 5426 | 52 | 71 |
| 3140 | 5295 | 38 | 57 |
| 3141 | 5094 | 11 | 31 |
| 3142 | 5415 | 50 | 73 |
| 3143 | 4794 | 104 | 125 |
| 3144 | 5250 | 11 | 34 |
| 3145 | 4735 | 11 | 34 |
| 3146 | 4799 | 11 | 34 |
| 3146 | 4703 | 6 | 29 |
| 3146 | 4615 | 45 | 68 |
| 3147 | 4686 | 205 | 224 |
| 3148 | 3980 | 70 | 90 |
| 3149 | 4109 | 221 | 244 |
| 3150 | 4610 | 57 | 76 |
| 3151 | 5167 | 176 | 196 |
| 3152 | 4149 | 11 | 34 |
| 3153 | 4384 | 1 | 20 |
| 3154 | 4899 | 143 | 164 |
| 3155 | 4405 | 11 | 31 |
| 3155 | 4462 | 11 | 31 |
| 3156 | 4990 | 200 | 220 |
| 3157 | 4497 | 74 | 96 |
| 3158 | 4041 | 11 | 34 |
| 3159 | 4646 | 46 | 67 |
| 3160 | 4623 | 385 | 404 |
| 3161 | 5202 | 11 | 30 |
| 3162 | 4970 | 11 | 33 |
| 3163 | 4788 | 204 | 227 |
| 3164 | 4937 | 11 | 30 |
| 3164 | 4837 | 11 | 30 |
| 3164 | 4893 | 11 | 30 |
| 3165 | 4694 | 11 | 32 |
| 3165 | 4792 | 11 | 32 |
| 3166 | 5388 | 71 | 90 |
| 3166 | 5387 | 71 | 90 |
| 3167 | 4443 | 35 | 58 |
| 3168 | 4867 | 59 | 78 |
| 3169 | 4692 | 29 | 48 |
| 3170 | 4224 | 11 | 31 |
| 3171 | 4498 | 11 | 34 |
| 3172 | 5273 | 11 | 32 |
| 3173 | 4927 | 54 | 77 |
| 3174 | 5024 | 11 | 31 |
| 3175 | 5431 | 265 | 285 |
| 3176 | 4315 | 40 | 63 |
| 3177 | 4575 | 11 | 33 |
| 3178 | 4459 | 193 | 216 |
| 3178 | 4340 | 194 | 217 |
| 3179 | 4194 | 11 | 34 |
| 3179 | 4152 | 99 | 122 |
| 3180 | 5436 | 92 | 111 |
| 3181 | 5427 | 35 | 54 |
| 3182 | 4033 | 39 | 61 |
| 3183 | 4643 | 223 | 243 |
| 3183 | 4609 | 223 | 243 |
| 3183 | 4808 | 223 | 243 |
| 3183 | 4802 | 181 | 201 |
| 3184 | 5145 | 227 | 250 |
| 3185 | 5029 | 67 | 90 |
| 3186 | 4261 | 185 | 207 |
| 3187 | 5036 | 169 | 188 |
| 3188 | 4146 | 11 | 33 |
| 3189 | 4549 | 11 | 31 |
| 3189 | 4576 | 11 | 31 |
| 3189 | 4548 | 11 | 31 |
| 3189 | 4594 | 11 | 31 |
| 3189 | 4732 | 4 | 24 |
| 3190 | 5015 | 11 | 34 |
| 3191 | 5046 | 64 | 84 |
| 3192 | 5280 | 11 | 34 |
| 3193 | 5343 | 152 | 173 |
| 3193 | 5352 | 11 | 32 |
| 3193 | 5490 | 11 | 32 |
| 3194 | 4465 | 11 | 34 |
| 3195 | 5142 | 11 | 32 |
| 3196 | 5039 | 11 | 31 |
| 3196 | 5053 | 11 | 31 |
| 3197 | 4521 | 68 | 88 |
| 3198 | 4975 | 11 | 30 |
| 3199 | 4415 | 11 | 33 |
| 3200 | 5261 | 37 | 59 |
| 3200 | 5113 | 11 | 33 |
| 3201 | 5087 | 11 | 34 |
| 3201 | 4866 | 122 | 145 |
| 3202 | 4834 | 11 | 31 |
| 3202 | 4651 | 11 | 31 |
| 3203 | 4513 | 217 | 239 |
| 3204 | 4175 | 57 | 80 |
| 3205 | 4839 | 11 | 34 |
| 3206 | 5253 | 41 | 60 |
| 3207 | 4881 | 11 | 33 |
| 3208 | 4715 | 11 | 31 |
| 3209 | 4618 | 400 | 423 |
| 3210 | 4648 | 11 | 30 |
| 3211 | 4362 | 45 | 65 |
| 3212 | 5149 | 226 | 248 |
| 3213 | 5286 | 81 | 102 |
| 3213 | 5300 | 81 | 102 |
| 3214 | 5074 | 11 | 34 |
| 3214 | 4849 | 11 | 34 |
| 3215 | 4762 | 52 | 72 |
| 3216 | 5377 | 11 | 34 |
| 3217 | 4751 | 34 | 53 |
| 3218 | 4841 | 11 | 30 |
| 3219 | 5186 | 11 | 31 |
| 3220 | 4520 | 30 | 49 |
| 3221 | 3986 | 116 | 139 |
| 3222 | 5420 | 149 | 168 |
| 3222 | 5450 | 149 | 168 |
| 3223 | 5282 | 35 | 57 |
| 3224 | 5319 | 104 | 124 |
| 3225 | 5100 | 35 | 56 |
| 3226 | 4250 | 11 | 31 |
| 3226 | 4268 | 11 | 31 |
| 3227 | 3936 | 111 | 131 |
| 3228 | 4191 | 37 | 60 |
| 3229 | 4740 | 11 | 34 |
| 3230 | 4300 | 118 | 141 |
| 3231 | 4819 | 11 | 32 |
| 3231 | 4689 | 11 | 32 |
| 3231 | 4662 | 11 | 32 |
| 3232 | 4658 | 10 | 33 |
| 3233 | 5340 | 154 | 176 |
| 3234 | 4375 | 11 | 33 |
| 3235 | 5131 | 9 | 31 |
| 3236 | 4724 | 139 | 159 |
| 3237 | 4256 | 52 | 74 |
| 3238 | 5051 | 34 | 55 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3239 | 4453 | 32 | 55 |
| 3240 | 5372 | 11 | 30 |
| 3241 | 4444 | 135 | 154 |
| 3241 | 4365 | 11 | 30 |
| 3242 | 4731 | 150 | 169 |
| 3243 | 5213 | 11 | 31 |
| 3244 | 5314 | 11 | 31 |
| 3245 | 4854 | 11 | 30 |
| 3246 | 5320 | 187 | 207 |
| 3247 | 4938 | 99 | 122 |
| 3248 | 4489 | 11 | 32 |
| 3249 | 5474 | 11 | 30 |
| 3249 | 5371 | 11 | 30 |
| 3250 | 5002 | 11 | 30 |
| 3251 | 4699 | 34 | 57 |
| 3252 | 4153 | 11 | 31 |
| 3253 | 4130 | 11 | 34 |
| 3254 | 5138 | 11 | 33 |
| 3255 | 5222 | 50 | 72 |
| 3255 | 5200 | 50 | 72 |
| 3256 | 4107 | 11 | 31 |
| 3257 | 4858 | 75 | 94 |
| 3258 | 4826 | 11 | 33 |
| 3259 | 5042 | 44 | 67 |
| 3260 | 4696 | 11 | 32 |
| 3261 | 4953 | 221 | 241 |
| 3262 | 4931 | 11 | 32 |
| 3263 | 3987 | 212 | 235 |
| 3264 | 3968 | 96 | 119 |
| 3265 | 4629 | 71 | 90 |
| 3266 | 4600 | 11 | 31 |
| 3266 | 4564 | 207 | 227 |
| 3267 | 4419 | 45 | 67 |
| 3268 | 4964 | 41 | 60 |
| 3269 | 4950 | 153 | 172 |
| 3270 | 4801 | 33 | 52 |
| 3271 | 4048 | 238 | 261 |
| 3272 | 5118 | 11 | 34 |
| 3272 | 5151 | 11 | 34 |
| 3272 | 5264 | 11 | 34 |
| 3273 | 4357 | 11 | 32 |
| 3274 | 4009 | 11 | 32 |
| 3275 | 5265 | 11 | 30 |
| 3275 | 5225 | 29 | 48 |
| 3275 | 5126 | 11 | 30 |
| 3275 | 5270 | 11 | 30 |
| 3275 | 5251 | 105 | 124 |
| 3275 | 5137 | 1 | 20 |
| 3276 | 4213 | 218 | 238 |
| 3277 | 4071 | 36 | 59 |
| 3278 | 4678 | 11 | 31 |
| 3279 | 4377 | 11 | 30 |
| 3280 | 4895 | 40 | 59 |
| 3280 | 5108 | 40 | 59 |
| 3280 | 4997 | 40 | 59 |
| 3280 | 4840 | 40 | 59 |
| 3280 | 5014 | 40 | 59 |
| 3280 | 4890 | 40 | 59 |
| 3280 | 4851 | 40 | 59 |
| 3281 | 4506 | 11 | 30 |
| 3282 | 4353 | 38 | 59 |
| 3282 | 4346 | 38 | 59 |
| 3283 | 4234 | 257 | 277 |
| 3283 | 4168 | 323 | 343 |
| 3283 | 4220 | 245 | 265 |
| 3284 | 4273 | 11 | 33 |
| 3285 | 5243 | 166 | 187 |
| 3286 | 4393 | 142 | 165 |
| 3287 | 4359 | 11 | 30 |
| 3288 | 5211 | 11 | 34 |
| 3288 | 5175 | 11 | 34 |
| 3288 | 5283 | 11 | 34 |
| 3289 | 4308 | 157 | 178 |
| 3290 | 3982 | 11 | 34 |
| 3291 | 4052 | 11 | 32 |
| 3292 | 4589 | 11 | 34 |
| 3293 | 4852 | 52 | 72 |
| 3294 | 4389 | 118 | 141 |
| 3295 | 4768 | 36 | 57 |
| 3296 | 4812 | 11 | 32 |
| 3297 | 3978 | 37 | 56 |
| 3298 | 4761 | 11 | 30 |
| 3298 | 4685 | 11 | 30 |
| 3299 | 4825 | 11 | 33 |
| 3299 | 4745 | 11 | 33 |
| 3299 | 4770 | 11 | 33 |
| 3300 | 5086 | 56 | 78 |
| 3301 | 4486 | 11 | 31 |
| 3302 | 4870 | 41 | 61 |
| 3302 | 5060 | 41 | 61 |
| 3303 | 4321 | 11 | 34 |
| 3304 | 4185 | 49 | 69 |
| 3304 | 4136 | 49 | 69 |
| 3304 | 4287 | 49 | 69 |
| 3304 | 4322 | 49 | 69 |
| 3305 | 4588 | 11 | 34 |
| 3306 | 5236 | 11 | 34 |
| 3307 | 4143 | 11 | 30 |
| 3308 | 4302 | 11 | 30 |
| 3308 | 4240 | 11 | 30 |
| 3309 | 4366 | 11 | 32 |
| 3310 | 5472 | 52 | 73 |
| 3311 | 4649 | 11 | 30 |
| 3312 | 4490 | 11 | 34 |
| 3313 | 4642 | 113 | 133 |
| 3314 | 4559 | 232 | 252 |
| 3314 | 4701 | 232 | 252 |
| 3315 | 4216 | 11 | 31 |
| 3316 | 4339 | 37 | 59 |
| 3317 | 4423 | 138 | 157 |
| 3318 | 5241 | 55 | 78 |
| 3319 | 5255 | 34 | 54 |
| 3320 | 3927 | 40 | 60 |
| 3320 | 3930 | 40 | 60 |
| 3320 | 3926 | 40 | 60 |
| 3320 | 3932 | 45 | 65 |
| 3320 | 3922 | 39 | 59 |
| 3320 | 3924 | 132 | 152 |
| 3320 | 3933 | 40 | 60 |
| 3321 | 4254 | 60 | 79 |
| 3322 | 5166 | 213 | 236 |
| 3323 | 4647 | 61 | 81 |
| 3323 | 4657 | 61 | 81 |
| 3323 | 4603 | 61 | 81 |
| 3324 | 5235 | 73 | 96 |
| 3325 | 4406 | 34 | 55 |
| 3326 | 5207 | 8 | 30 |
| 3327 | 4800 | 11 | 32 |
| 3328 | 4942 | 11 | 32 |
| 3329 | 4796 | 11 | 34 |
| 3330 | 4998 | 35 | 56 |
| 3331 | 4741 | 240 | 261 |
| 3332 | 5306 | 60 | 83 |
| 3333 | 4555 | 181 | 203 |
| 3334 | 4909 | 41 | 60 |
| 3335 | 5304 | 11 | 34 |
| 3335 | 5383 | 11 | 34 |
| 3336 | 5462 | 31 | 50 |
| 3337 | 4636 | 11 | 33 |
| 3337 | 4683 | 11 | 33 |
| 3338 | 5105 | 40 | 63 |
| 3339 | 4552 | 100 | 122 |
| 3340 | 4078 | 39 | 62 |
| 3341 | 4835 | 11 | 31 |
| 3342 | 5187 | 75 | 96 |
| 3343 | 4679 | 158 | 181 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3344 | 4865 | 11 | 32 |
| 3344 | 4862 | 11 | 32 |
| 3345 | 5274 | 11 | 34 |
| 3346 | 4936 | 11 | 33 |
| 3347 | 4352 | 11 | 31 |
| 3348 | 4221 | 11 | 31 |
| 3349 | 5072 | 11 | 31 |
| 3349 | 5083 | 11 | 31 |
| 3350 | 4695 | 117 | 139 |
| 3351 | 5230 | 71 | 94 |
| 3352 | 4961 | 167 | 187 |
| 3353 | 5227 | 11 | 30 |
| 3354 | 4147 | 92 | 115 |
| 3355 | 4536 | 11 | 33 |
| 3356 | 5443 | 110 | 130 |
| 3357 | 5321 | 247 | 266 |
| 3358 | 4196 | 28 | 47 |
| 3359 | 5487 | 35 | 56 |
| 3360 | 4227 | 11 | 30 |
| 3361 | 4488 | 119 | 139 |
| 3362 | 4001 | 107 | 130 |
| 3362 | 4003 | 8 | 31 |
| 3362 | 4012 | 105 | 128 |
| 3362 | 4011 | 112 | 135 |
| 3363 | 4926 | 136 | 155 |
| 3364 | 5433 | 11 | 34 |
| 3364 | 3961 | 11 | 34 |
| 3364 | 4005 | 11 | 34 |
| 3364 | 3960 | 11 | 34 |
| 3364 | 3947 | 151 | 174 |
| 3364 | 3976 | 11 | 34 |
| 3364 | 3966 | 106 | 129 |
| 3364 | 3973 | 11 | 34 |
| 3364 | 3950 | 11 | 34 |
| 3364 | 3958 | 11 | 34 |
| 3364 | 3962 | 11 | 34 |
| 3364 | 3969 | 11 | 34 |
| 3364 | 3957 | 11 | 34 |
| 3364 | 4002 | 104 | 127 |
| 3364 | 3954 | 11 | 34 |
| 3364 | 3952 | 7 | 30 |
| 3364 | 3946 | 11 | 34 |
| 3364 | 3948 | 11 | 34 |
| 3364 | 4006 | 11 | 34 |
| 3364 | 3970 | 11 | 34 |
| 3364 | 3965 | 11 | 34 |
| 3365 | 5161 | 50 | 71 |
| 3365 | 5165 | 50 | 71 |
| 3365 | 5173 | 50 | 71 |
| 3366 | 4460 | 11 | 30 |
| 3367 | 4690 | 11 | 31 |
| 3368 | 4337 | 87 | 110 |
| 3369 | 4534 | 201 | 222 |
| 3370 | 4040 | 7 | 30 |
| 3371 | 5004 | 11 | 34 |
| 3372 | 4720 | 41 | 63 |
| 3372 | 4554 | 40 | 62 |
| 3372 | 4688 | 40 | 62 |
| 3373 | 4401 | 11 | 31 |
| 3373 | 4355 | 139 | 159 |
| 3374 | 4418 | 11 | 33 |
| 3374 | 4412 | 11 | 33 |
| 3375 | 4098 | 38 | 58 |
| 3376 | 5378 | 11 | 31 |
| 3377 | 4562 | 11 | 30 |
| 3378 | 4813 | 38 | 57 |
| 3379 | 4804 | 153 | 173 |
| 3379 | 4613 | 153 | 173 |
| 3380 | 4088 | 11 | 34 |
| 3381 | 4644 | 229 | 252 |
| 3382 | 4708 | 11 | 31 |
| 3383 | 5206 | 11 | 30 |
| 3384 | 4301 | 36 | 59 |
| 3385 | 4471 | 11 | 31 |
| 3386 | 4951 | 11 | 30 |
| 3386 | 5097 | 11 | 30 |
| 3386 | 4904 | 11 | 30 |
| 3386 | 5107 | 11 | 30 |
| 3386 | 5007 | 11 | 30 |
| 3387 | 4298 | 204 | 223 |
| 3388 | 4984 | 41 | 64 |
| 3389 | 5027 | 11 | 31 |
| 3390 | 4082 | 51 | 73 |
| 3391 | 4640 | 165 | 184 |
| 3392 | 4427 | 11 | 31 |
| 3393 | 4411 | 11 | 30 |
| 3394 | 4855 | 45 | 68 |
| 3395 | 5220 | 11 | 32 |
| 3395 | 5272 | 11 | 32 |
| 3396 | 4335 | 11 | 32 |
| 3397 | 5476 | 215 | 236 |
| 3397 | 5390 | 215 | 236 |
| 3398 | 4442 | 87 | 107 |
| 3399 | 4838 | 11 | 30 |
| 3400 | 4222 | 37 | 58 |
| 3401 | 4435 | 11 | 34 |
| 3402 | 3990 | 11 | 34 |
| 3403 | 5176 | 200 | 219 |
| 3404 | 5297 | 49 | 72 |
| 3405 | 4095 | 61 | 84 |
| 3406 | 4906 | 11 | 32 |
| 3407 | 4172 | 11 | 31 |
| 3408 | 4226 | 74 | 96 |
| 3409 | 5195 | 79 | 98 |
| 3410 | 4941 | 33 | 54 |
| 3411 | 4330 | 11 | 31 |
| 3412 | 4666 | 11 | 30 |
| 3413 | 4316 | 72 | 95 |
| 3414 | 5168 | 33 | 53 |
| 3414 | 5210 | 33 | 53 |
| 3415 | 5484 | 37 | 60 |
| 3415 | 5491 | 47 | 70 |
| 3415 | 5401 | 37 | 60 |
| 3415 | 5455 | 37 | 60 |
| 3415 | 5458 | 37 | 60 |
| 3415 | 5402 | 38 | 61 |
| 3416 | 4960 | 11 | 34 |
| 3416 | 4919 | 11 | 34 |
| 3416 | 5035 | 11 | 34 |
| 3416 | 5093 | 11 | 34 |
| 3417 | 5406 | 64 | 84 |
| 3418 | 4512 | 56 | 78 |
| 3419 | 4793 | 197 | 217 |
| 3420 | 4712 | 42 | 61 |
| 3420 | 4675 | 42 | 61 |
| 3421 | 5103 | 11 | 30 |
| 3421 | 4923 | 11 | 30 |
| 3421 | 5043 | 11 | 30 |
| 3422 | 4203 | 11 | 30 |
| 3423 | 4369 | 255 | 274 |
| 3424 | 5488 | 11 | 31 |
| 3425 | 4857 | 11 | 33 |
| 3425 | 4910 | 11 | 33 |
| 3426 | 4403 | 11 | 34 |
| 3427 | 4356 | 75 | 98 |
| 3428 | 4354 | 11 | 32 |
| 3429 | 4766 | 11 | 31 |
| 3429 | 4730 | 11 | 31 |
| 3429 | 4760 | 11 | 31 |
| 3429 | 4561 | 11 | 31 |
| 3430 | 5244 | 11 | 30 |
| 3431 | 5294 | 11 | 34 |
| 3432 | 4985 | 74 | 93 |
| 3433 | 4000 | 11 | 34 |
| 3434 | 4574 | 11 | 34 |
| 3435 | 4231 | 11 | 34 |

TABLE 4-continued

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 3436 | 4439 | 215 | 238 |
| 3437 | 5454 | 84 | 104 |
| 3437 | 5328 | 78 | 98 |
| 3438 | 5228 | 11 | 30 |
| 3439 | 5432 | 34 | 53 |
| 3440 | 5144 | 11 | 30 |
| 3441 | 4424 | 136 | 159 |
| 3442 | 5290 | 11 | 30 |
| 3443 | 5332 | 11 | 31 |
| 3444 | 4090 | 11 | 34 |
| 3445 | 4743 | 190 | 210 |
| 3446 | 4438 | 11 | 34 |
| 3447 | 4069 | 11 | 31 |
| 3447 | 4072 | 11 | 31 |
| 3448 | 4392 | 11 | 34 |
| 3449 | 4828 | 11 | 31 |
| 3450 | 3992 | 81 | 104 |
| 3451 | 4868 | 45 | 64 |
| 3452 | 4128 | 11 | 31 |
| 3453 | 4338 | 111 | 134 |
| 3454 | 4288 | 11 | 31 |
| 3455 | 4202 | 11 | 30 |
| 3456 | 5010 | 11 | 34 |
| 3457 | 4928 | 48 | 71 |
| 3458 | 4601 | 43 | 64 |
| 3458 | 4723 | 43 | 64 |
| 3458 | 4582 | 11 | 32 |
| 3458 | 4786 | 11 | 32 |
| 3459 | 4929 | 117 | 136 |
| 3460 | 4074 | 11 | 34 |
| 3461 | 4183 | 11 | 30 |
| 3462 | 4450 | 126 | 149 |
| 3463 | 4805 | 39 | 62 |
| 3464 | 4898 | 11 | 30 |
| 3465 | 4949 | 76 | 97 |
| 3466 | 4769 | 32 | 51 |
| 3467 | 4833 | 43 | 66 |
| 3467 | 4550 | 43 | 66 |
| 3468 | 4988 | 50 | 73 |
| 3469 | 4414 | 47 | 66 |
| 3470 | 5064 | 34 | 55 |
| 3471 | 4381 | 117 | 138 |
| 3472 | 4939 | 11 | 34 |
| 3473 | 5115 | 11 | 32 |
| 3474 | 5139 | 11 | 33 |
| 3475 | 4907 | 83 | 102 |
| 3476 | 4343 | 11 | 34 |
| 3476 | 4348 | 42 | 65 |
| 3477 | 4091 | 54 | 75 |
| 3478 | 4932 | 60 | 80 |
| 3479 | 4775 | 11 | 32 |
| 3480 | 4345 | 11 | 32 |
| 3481 | 4900 | 11 | 31 |
| 3482 | 4155 | 11 | 34 |
| 3483 | 5226 | 287 | 309 |
| 3484 | 4283 | 45 | 64 |
| 3485 | 4935 | 245 | 265 |
| 3486 | 5214 | 72 | 91 |
| 3487 | 5189 | 46 | 69 |
| 3488 | 4529 | 156 | 179 |
| 3489 | 4367 | 11 | 34 |
| 3490 | 4563 | 11 | 32 |
| 3491 | 4585 | 11 | 30 |
| 3492 | 4049 | 114 | 137 |
| 3493 | 4795 | 39 | 60 |
| 3494 | 3988 | 11 | 30 |
| 3495 | 4050 | 74 | 97 |
| 3496 | 5335 | 11 | 32 |
| 3497 | 4634 | 11 | 30 |
| 3498 | 4934 | 11 | 30 |
| 3499 | 4624 | 65 | 84 |
| 3500 | 4911 | 76 | 96 |
| 3501 | 5466 | 11 | 33 |
| 3502 | 5316 | 146 | 165 |
| 3503 | 4832 | 34 | 54 |
| 3503 | 4756 | 34 | 54 |
| 3504 | 4342 | 11 | 33 |
| 3505 | 4622 | 37 | 56 |
| 3506 | 5289 | 11 | 30 |
| 3507 | 5464 | 130 | 153 |
| 3508 | 5054 | 11 | 30 |
| 3509 | 4480 | 11 | 34 |
| 3509 | 4351 | 11 | 34 |
| 3510 | 5325 | 11 | 33 |
| 3511 | 5475 | 11 | 31 |
| 3512 | 5305 | 11 | 33 |
| 3513 | 4307 | 63 | 86 |
| 3514 | 4290 | 37 | 59 |
| 3515 | 5281 | 11 | 33 |
| 3516 | 4544 | 114 | 137 |
| 3516 | 4739 | 214 | 237 |
| 3516 | 4681 | 32 | 55 |
| 3517 | 4332 | 79 | 102 |
| 3518 | 4747 | 52 | 74 |
| 3519 | 5391 | 11 | 32 |
| 3520 | 5192 | 11 | 30 |
| 3521 | 4249 | 40 | 62 |
| 3522 | 4816 | 303 | 326 |
| 3523 | 4150 | 11 | 31 |
| 3523 | 4296 | 11 | 31 |
| 3523 | 4118 | 11 | 31 |
| 3523 | 4320 | 11 | 31 |
| 3523 | 4294 | 11 | 31 |
| 3523 | 4225 | 11 | 31 |
| 3524 | 5447 | 1 | 22 |
| 3525 | 4612 | 11 | 31 |
| 3526 | 5057 | 87 | 106 |
| 3527 | 5122 | 11 | 30 |
| 3528 | 5291 | 133 | 153 |
| 3529 | 3931 | 123 | 143 |
| 3530 | 5068 | 119 | 138 |
| 3531 | 4971 | 32 | 52 |
| 3531 | 4885 | 32 | 52 |
| 3531 | 4915 | 33 | 53 |
| 3532 | 5079 | 11 | 30 |
| 3533 | 5293 | 53 | 76 |
| 3534 | 4331 | 11 | 32 |
| 3535 | 4094 | 231 | 254 |
| 3536 | 4368 | 11 | 33 |
| 3536 | 4484 | 11 | 33 |
| 3537 | 5342 | 142 | 161 |
| 3538 | 4482 | 45 | 68 |
| 3539 | 4886 | 127 | 146 |
| 3540 | 4015 | 86 | 109 |
| 3540 | 4018 | 11 | 34 |
| 3540 | 4017 | 85 | 108 |
| 3540 | 4025 | 85 | 108 |
| 3540 | 4016 | 85 | 108 |
| 3540 | 4014 | 11 | 34 |
| 3540 | 4023 | 85 | 108 |
| 3540 | 4021 | 85 | 108 |
| 3540 | 4020 | 85 | 108 |
| 3540 | 4027 | 11 | 34 |
| 3540 | 4028 | 11 | 34 |
| 3540 | 4013 | 85 | 108 |
| 3540 | 4019 | 85 | 108 |
| 3541 | 5140 | 11 | 30 |
| 3542 | 4823 | 185 | 205 |
| 3543 | 4806 | 11 | 32 |
| 3544 | 4954 | 11 | 30 |
| 3545 | 4292 | 11 | 30 |
| 3546 | 4184 | 11 | 32 |
| 3547 | 4989 | 11 | 31 |
| 3548 | 4496 | 11 | 34 |
| 3549 | 4311 | 50 | 69 |
| 3549 | 4112 | 11 | 30 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3550 | 4568 | 11 | 30 |
| 3550 | 4540 | 11 | 30 |
| 3551 | 4822 | 78 | 99 |
| 3552 | 5389 | 11 | 31 |
| 3553 | 5285 | 227 | 246 |
| 3554 | 5493 | 11 | 32 |
| 3555 | 4140 | 153 | 172 |
| 3556 | 5065 | 41 | 60 |
| 3557 | 5323 | 11 | 34 |
| 3558 | 4974 | 11 | 33 |
| 3559 | 4297 | 303 | 324 |
| 3560 | 4510 | 11 | 34 |
| 3561 | 4781 | 139 | 162 |
| 3562 | 4242 | 223 | 245 |
| 3562 | 4178 | 223 | 245 |
| 3562 | 4177 | 223 | 245 |
| 3562 | 4190 | 223 | 245 |
| 3562 | 4257 | 223 | 245 |
| 3563 | 3996 | 11 | 31 |
| 3564 | 4081 | 69 | 92 |
| 3565 | 4579 | 60 | 79 |
| 3566 | 5099 | 136 | 155 |
| 3567 | 4665 | 238 | 259 |
| 3568 | 5069 | 101 | 120 |
| 3569 | 5367 | 11 | 32 |
| 3570 | 4010 | 50 | 73 |
| 3571 | 5413 | 11 | 31 |
| 3572 | 4532 | 11 | 32 |
| 3573 | 4654 | 11 | 31 |
| 3574 | 4422 | 49 | 71 |
| 3575 | 5080 | 11 | 34 |
| 3576 | 4979 | 11 | 31 |
| 3576 | 5067 | 11 | 31 |
| 3577 | 4856 | 11 | 32 |
| 3578 | 4966 | 38 | 61 |
| 3579 | 4400 | 48 | 67 |
| 3580 | 4437 | 11 | 31 |
| 3581 | 5123 | 39 | 62 |
| 3582 | 5215 | 11 | 34 |
| 3582 | 5155 | 40 | 63 |
| 3582 | 5182 | 40 | 63 |
| 3582 | 5266 | 40 | 63 |
| 3583 | 4672 | 11 | 32 |
| 3584 | 5082 | 51 | 71 |
| 3584 | 4913 | 37 | 57 |
| 3585 | 4956 | 88 | 111 |
| 3586 | 5203 | 11 | 31 |
| 3587 | 4455 | 133 | 152 |
| 3588 | 4145 | 11 | 34 |
| 3588 | 4323 | 11 | 34 |
| 3589 | 5412 | 11 | 31 |
| 3590 | 4161 | 11 | 32 |
| 3590 | 4252 | 11 | 32 |
| 3591 | 5212 | 133 | 153 |
| 3591 | 5179 | 133 | 153 |
| 3592 | 4946 | 113 | 135 |
| 3593 | 4632 | 226 | 249 |
| 3594 | 5441 | 94 | 117 |
| 3595 | 4551 | 11 | 32 |
| 3596 | 5078 | 11 | 33 |
| 3597 | 4430 | 11 | 32 |
| 3598 | 4170 | 43 | 65 |
| 3599 | 4266 | 11 | 33 |
| 3599 | 4267 | 11 | 33 |
| 3599 | 4165 | 11 | 33 |
| 3599 | 4305 | 11 | 33 |
| 3600 | 4282 | 33 | 53 |
| 3601 | 5150 | 68 | 87 |
| 3602 | 5403 | 81 | 103 |
| 3602 | 5492 | 81 | 103 |
| 3603 | 4493 | 373 | 392 |
| 3604 | 4211 | 11 | 34 |
| 3605 | 5075 | 11 | 31 |
| 3606 | 4973 | 11 | 30 |
| 3607 | 4884 | 107 | 126 |
| 3608 | 5438 | 11 | 31 |
| 3608 | 5416 | 11 | 31 |
| 3609 | 4780 | 214 | 234 |
| 3610 | 4426 | 11 | 33 |
| 3611 | 4344 | 11 | 32 |
| 3612 | 4887 | 163 | 186 |
| 3613 | 4144 | 11 | 31 |
| 3614 | 4667 | 102 | 125 |
| 3615 | 5249 | 37 | 60 |
| 3615 | 5218 | 36 | 59 |
| 3615 | 5129 | 36 | 59 |
| 3616 | 4725 | 11 | 32 |
| 3616 | 4719 | 11 | 32 |
| 3616 | 4538 | 11 | 32 |
| 3616 | 4765 | 11 | 32 |
| 3616 | 4547 | 11 | 32 |
| 3616 | 4661 | 11 | 32 |
| 3616 | 4809 | 11 | 32 |
| 3616 | 4604 | 11 | 32 |
| 3616 | 4541 | 11 | 32 |
| 3616 | 4650 | 11 | 32 |
| 3617 | 4349 | 11 | 30 |
| 3618 | 5400 | 57 | 79 |
| 3619 | 4515 | 11 | 31 |
| 3620 | 5114 | 11 | 32 |
| 3621 | 4569 | 92 | 112 |
| 3622 | 4830 | 143 | 162 |
| 3623 | 4810 | 35 | 56 |
| 3623 | 4764 | 198 | 219 |
| 3624 | 4616 | 99 | 118 |
| 3625 | 4487 | 111 | 131 |
| 3626 | 4472 | 43 | 62 |
| 3627 | 5337 | 11 | 34 |
| 3628 | 5158 | 11 | 31 |
| 3629 | 5309 | 11 | 34 |
| 3630 | 5418 | 94 | 117 |
| 3630 | 5439 | 94 | 117 |
| 3631 | 5424 | 36 | 56 |
| 3632 | 5307 | 42 | 65 |
| 3633 | 4245 | 11 | 33 |
| 3634 | 4523 | 134 | 157 |
| 3634 | 4507 | 41 | 64 |
| 3635 | 4653 | 119 | 142 |
| 3636 | 5171 | 38 | 58 |
| 3637 | 5322 | 88 | 107 |
| 3637 | 5347 | 85 | 104 |
| 3638 | 4469 | 11 | 31 |
| 3638 | 4371 | 11 | 31 |
| 3638 | 4404 | 108 | 128 |
| 3639 | 4875 | 11 | 32 |
| 3640 | 5133 | 67 | 90 |
| 3641 | 5092 | 11 | 34 |
| 3642 | 4587 | 11 | 30 |
| 3643 | 4329 | 78 | 100 |
| 3644 | 4896 | 50 | 71 |
| 3645 | 3991 | 7 | 29 |
| 3646 | 4347 | 51 | 74 |
| 3647 | 4037 | 94 | 114 |
| 3647 | 4038 | 11 | 31 |
| 3647 | 4034 | 104 | 124 |
| 3648 | 5104 | 81 | 101 |
| 3649 | 4188 | 58 | 81 |
| 3650 | 4711 | 162 | 183 |
| 3650 | 4831 | 162 | 183 |
| 3650 | 4652 | 162 | 183 |
| 3651 | 4079 | 11 | 33 |
| 3652 | 4219 | 11 | 34 |
| 3653 | 4959 | 131 | 150 |
| 3654 | 4173 | 240 | 263 |
| 3655 | 4134 | 11 | 30 |
| 3656 | 4361 | 11 | 30 |

TABLE 4-continued

Maize and rice miRNAs and miRNA precursors

| miRNA SEQ ID NO. | pre-miRNA SEQ ID NO. | Nucleotide position of miRNA in pre-miRNA | |
|---|---|---|---|
| | | from | to |
| 3657 | 4451 | 11 | 31 |
| 3658 | 4871 | 11 | 33 |
| 3659 | 4043 | 11 | 34 |
| 3660 | 4387 | 11 | 32 |
| 3661 | 4425 | 41 | 61 |
| 3661 | 4457 | 42 | 62 |
| 3662 | 5409 | 56 | 75 |
| 3662 | 5497 | 62 | 81 |
| 3663 | 4129 | 11 | 31 |
| 3664 | 4746 | 11 | 33 |
| 3665 | 5425 | 11 | 33 |
| 3666 | 4860 | 11 | 31 |
| 3667 | 4655 | 11 | 32 |
| 3668 | 4967 | 11 | 30 |
| 3668 | 4843 | 71 | 90 |
| 3669 | 5485 | 11 | 30 |
| 3669 | 5338 | 11 | 30 |
| 3669 | 5478 | 11 | 30 |
| 3670 | 3989 | 11 | 33 |
| 3671 | 4978 | 11 | 30 |
| 3672 | 4325 | 11 | 34 |
| 3672 | 4197 | 201 | 224 |
| 3672 | 4181 | 11 | 34 |
| 3673 | 4046 | 128 | 151 |
| 3674 | 5246 | 209 | 232 |
| 3675 | 4952 | 34 | 53 |
| 3676 | 4976 | 62 | 83 |
| 3677 | 4163 | 11 | 30 |
| 3678 | 4445 | 11 | 30 |
| 3679 | 4777 | 84 | 103 |
| 3680 | 5422 | 47 | 70 |
| 3681 | 4524 | 42 | 61 |
| 3682 | 4068 | 11 | 31 |
| 3683 | 4511 | 183 | 206 |
| 3684 | 5496 | 11 | 31 |
| 3685 | 4557 | 155 | 178 |
| 3686 | 4310 | 11 | 31 |
| 3687 | 5254 | 46 | 68 |
| 3688 | 5000 | 44 | 64 |
| 3688 | 4905 | 11 | 31 |
| 3689 | 4848 | 150 | 170 |
| 3689 | 4903 | 150 | 170 |
| 3689 | 4889 | 177 | 197 |
| 3689 | 4994 | 150 | 170 |
| 3690 | 4995 | 43 | 63 |
| 3690 | 4943 | 43 | 63 |
| 3691 | 5399 | 38 | 57 |
| 3692 | 5480 | 128 | 151 |
| 3693 | 4817 | 11 | 34 |
| 3694 | 5301 | 11 | 34 |
| 3695 | 5009 | 79 | 100 |
| 3696 | 4125 | 43 | 63 |
| 3697 | 4360 | 11 | 32 |
| 3698 | 4113 | 71 | 90 |
| 3699 | 4901 | 11 | 31 |
| 3699 | 4922 | 11 | 31 |
| 3700 | 5012 | 231 | 250 |
| 3700 | 4980 | 231 | 250 |
| 3701 | 4284 | 73 | 95 |
| 3702 | 4639 | 11 | 34 |
| 3703 | 4189 | 36 | 59 |
| 3704 | 5483 | 68 | 87 |
| 3705 | 5058 | 11 | 34 |
| 3706 | 5037 | 57 | 77 |
| 3707 | 4382 | 31 | 51 |
| 3708 | 5364 | 11 | 31 |
| 3708 | 5419 | 11 | 31 |
| 3709 | 4669 | 11 | 32 |
| 3710 | 4519 | 151 | 174 |
| 3711 | 4693 | 11 | 30 |
| 3712 | 4433 | 11 | 34 |
| 3713 | 4790 | 11 | 33 |
| 3714 | 4595 | 67 | 89 |
| 3715 | 4248 | 41 | 60 |
| 3716 | 4164 | 156 | 176 |
| 3717 | 4993 | 110 | 133 |
| 3718 | 4186 | 11 | 32 |
| 3718 | 4133 | 63 | 84 |
| 3719 | 4463 | 11 | 34 |
| 3720 | 4963 | 11 | 34 |
| 3721 | 4324 | 11 | 30 |
| 3721 | 4281 | 11 | 30 |
| 3722 | 4198 | 11 | 32 |
| 3723 | 4811 | 149 | 172 |
| 3724 | 4676 | 220 | 239 |
| 3725 | 4706 | 43 | 64 |
| 3726 | 4004 | 11 | 31 |
| 3727 | 5252 | 11 | 32 |
| 3728 | 5259 | 11 | 34 |
| 3729 | 5256 | 35 | 54 |
| 3730 | 4539 | 138 | 159 |
| 3730 | 4599 | 11 | 32 |
| 3731 | 4700 | 40 | 63 |
| 3732 | 4533 | 11 | 34 |
| 3733 | 4264 | 11 | 31 |
| 3734 | 4996 | 11 | 31 |
| 3735 | 4148 | 11 | 33 |
| 3736 | 4481 | 11 | 30 |
| 3737 | 4607 | 11 | 30 |
| 3738 | 4627 | 242 | 261 |
| 3739 | 5239 | 37 | 58 |
| 3740 | 5154 | 11 | 34 |
| 3741 | 4925 | 11 | 32 |
| 3742 | 4754 | 101 | 120 |
| 3743 | 4785 | 70 | 89 |
| 3743 | 4619 | 70 | 89 |
| 3743 | 4597 | 70 | 89 |
| 3743 | 4797 | 105 | 124 |
| 3744 | 5191 | 11 | 34 |
| 3744 | 5172 | 11 | 34 |
| 3745 | 5177 | 176 | 199 |
| 3746 | 4192 | 11 | 32 |
| 3747 | 4326 | 11 | 31 |
| 3748 | 3939 | 11 | 34 |
| 3749 | 4983 | 11 | 34 |
| 3749 | 4944 | 11 | 34 |
| 3750 | 5101 | 94 | 113 |
| 3751 | 4374 | 69 | 92 |
| 3752 | 4987 | 11 | 30 |
| 3753 | 4572 | 11 | 30 |
| 3754 | 4755 | 43 | 66 |
| 3755 | 5234 | 11 | 34 |
| 3756 | 4396 | 11 | 30 |
| 3757 | 4120 | 212 | 231 |
| 3758 | 4210 | 136 | 157 |
| 3759 | 5157 | 11 | 34 |
| 3760 | 3993 | 33 | 54 |
| 3761 | 5373 | 118 | 138 |
| 3762 | 4621 | 37 | 56 |
| 3762 | 4581 | 37 | 56 |
| 3762 | 4803 | 37 | 56 |
| 3763 | 5052 | 5 | 24 |
| 3764 | 4372 | 11 | 31 |
| 3765 | 4429 | 11 | 31 |
| 3766 | 5375 | 227 | 250 |
| 3767 | 4883 | 44 | 64 |
| 3767 | 4916 | 44 | 64 |
| 3768 | 4728 | 11 | 34 |
| 3769 | 4757 | 45 | 67 |
| 3770 | 3951 | 11 | 31 |
| 3771 | 5164 | 41 | 64 |
| 3772 | 4556 | 11 | 32 |
| 3772 | 4821 | 162 | 183 |
| 3773 | 5428 | 44 | 67 |
| 3774 | 4491 | 11 | 31 |
| 3775 | 5263 | 116 | 136 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3776 | 4205 | 11 | 30 |
| 3776 | 4236 | 32 | 51 |
| 3776 | 4243 | 230 | 249 |
| 3776 | 4195 | 33 | 52 |
| 3777 | 4260 | 52 | 75 |
| 3778 | 4727 | 51 | 74 |
| 3779 | 4160 | 11 | 31 |
| 3779 | 4157 | 11 | 31 |
| 3780 | 5117 | 79 | 99 |
| 3781 | 4434 | 162 | 181 |
| 3782 | 5021 | 11 | 34 |
| 3783 | 4479 | 11 | 30 |
| 3783 | 4395 | 11 | 30 |
| 3784 | 5411 | 181 | 203 |
| 3784 | 5414 | 214 | 236 |
| 3784 | 5339 | 214 | 236 |
| 3785 | 5209 | 134 | 154 |
| 3786 | 4265 | 11 | 30 |
| 3787 | 5128 | 11 | 30 |
| 3788 | 5181 | 86 | 105 |
| 3789 | 5194 | 11 | 30 |
| 3790 | 4778 | 194 | 215 |
| 3791 | 4902 | 32 | 53 |
| 3791 | 4861 | 32 | 53 |
| 3792 | 4272 | 11 | 34 |
| 3793 | 5233 | 11 | 32 |
| 3794 | 4608 | 199 | 222 |
| 3795 | 4228 | 42 | 65 |
| 3796 | 4350 | 11 | 34 |
| 3797 | 5111 | 11 | 32 |
| 3798 | 4306 | 66 | 85 |
| 3799 | 5313 | 31 | 51 |
| 3799 | 5345 | 32 | 52 |
| 3800 | 5049 | 110 | 130 |
| 3801 | 5231 | 99 | 121 |
| 3802 | 5257 | 11 | 34 |
| 3803 | 4992 | 119 | 139 |
| 3804 | 4590 | 11 | 30 |
| 3805 | 4470 | 49 | 70 |
| 3806 | 5495 | 78 | 100 |
| 3807 | 5405 | 203 | 226 |
| 3808 | 4454 | 37 | 57 |
| 3808 | 4535 | 37 | 57 |
| 3809 | 5481 | 42 | 64 |
| 3810 | 4100 | 135 | 154 |
| 3811 | 4077 | 49 | 72 |
| 3812 | 4859 | 11 | 31 |
| 3812 | 5088 | 11 | 31 |
| 3813 | 5089 | 11 | 34 |
| 3814 | 4452 | 66 | 87 |
| 3815 | 4698 | 45 | 65 |
| 3816 | 4394 | 11 | 30 |
| 3817 | 4410 | 49 | 72 |
| 3818 | 4158 | 71 | 90 |
| 3819 | 4891 | 45 | 65 |
| 3820 | 4758 | 68 | 91 |
| 3821 | 4509 | 11 | 31 |
| 3822 | 4295 | 33 | 52 |
| 3822 | 4317 | 33 | 52 |
| 3823 | 5201 | 11 | 34 |
| 3824 | 5045 | 112 | 131 |
| 3825 | 4237 | 79 | 102 |
| 3826 | 4897 | 11 | 30 |
| 3827 | 4485 | 233 | 254 |
| 3828 | 4408 | 28 | 51 |
| 3829 | 4417 | 11 | 32 |
| 3829 | 4528 | 36 | 57 |
| 3830 | 4303 | 179 | 202 |
| 3831 | 3981 | 11 | 34 |
| 3832 | 5076 | 11 | 31 |
| 3833 | 4580 | 11 | 32 |
| 3834 | 4494 | 11 | 31 |
| 3835 | 4119 | 11 | 34 |
| 3836 | 4637 | 92 | 115 |
| 3837 | 4407 | 11 | 34 |
| 3838 | 4912 | 11 | 30 |
| 3839 | 4673 | 11 | 32 |
| 3840 | 4882 | 241 | 261 |
| 3841 | 4278 | 76 | 96 |
| 3842 | 4879 | 11 | 32 |
| 3843 | 5125 | 29 | 48 |
| 3844 | 4476 | 41 | 64 |
| 3845 | 4641 | 11 | 31 |
| 3846 | 5216 | 11 | 33 |
| 3847 | 4241 | 49 | 70 |
| 3848 | 4945 | 11 | 30 |
| 3849 | 4162 | 11 | 30 |
| 3850 | 5032 | 11 | 33 |
| 3851 | 4593 | 11 | 34 |
| 3852 | 3997 | 11 | 34 |
| 3853 | 4431 | 11 | 31 |
| 3854 | 4571 | 40 | 59 |
| 3854 | 4630 | 40 | 59 |
| 3855 | 4096 | 36 | 57 |
| 3855 | 4092 | 11 | 32 |
| 3856 | 5296 | 38 | 59 |
| 3857 | 4626 | 11 | 30 |
| 3858 | 4212 | 104 | 127 |
| 3859 | 4577 | 177 | 197 |
| 3860 | 4229 | 11 | 30 |
| 3860 | 4182 | 11 | 30 |
| 3861 | 4968 | 11 | 30 |
| 3862 | 5299 | 11 | 32 |
| 3863 | 4042 | 11 | 34 |
| 3864 | 4475 | 11 | 32 |
| 3865 | 4386 | 34 | 54 |
| 3865 | 4432 | 34 | 54 |
| 3866 | 4441 | 11 | 32 |
| 3866 | 4416 | 11 | 32 |
| 3867 | 4545 | 11 | 30 |
| 3868 | 4820 | 34 | 54 |
| 3869 | 5056 | 61 | 80 |
| 3870 | 5102 | 11 | 31 |
| 3871 | 5019 | 93 | 114 |
| 3872 | 4262 | 43 | 66 |
| 3872 | 4200 | 43 | 66 |
| 3873 | 5081 | 34 | 53 |
| 3873 | 5044 | 34 | 53 |
| 3874 | 4986 | 122 | 141 |
| 3875 | 4271 | 11 | 31 |
| 3876 | 4397 | 43 | 62 |
| 3877 | 4850 | 104 | 124 |
| 3878 | 4584 | 11 | 30 |
| 3879 | 5016 | 49 | 72 |
| 3880 | 4156 | 8 | 31 |
| 3881 | 4274 | 44 | 63 |
| 3881 | 4131 | 44 | 63 |
| 3881 | 4114 | 44 | 63 |
| 3881 | 4124 | 11 | 30 |
| 3881 | 4289 | 44 | 63 |
| 3882 | 5148 | 11 | 34 |
| 3882 | 5229 | 11 | 34 |
| 3883 | 4436 | 11 | 32 |
| 3884 | 4940 | 47 | 68 |
| 3884 | 4845 | 47 | 68 |
| 3884 | 5025 | 47 | 68 |
| 3885 | 5055 | 11 | 34 |
| 3886 | 4255 | 65 | 85 |
| 3887 | 5096 | 11 | 32 |
| 3888 | 4304 | 141 | 161 |
| 3888 | 4277 | 141 | 161 |
| 3889 | 4358 | 11 | 30 |
| 3890 | 4645 | 11 | 34 |
| 3891 | 4977 | 11 | 30 |
| 3892 | 4628 | 11 | 32 |
| 3893 | 4592 | 37 | 57 |

TABLE 4-continued

Maize and rice miRNAs and miRNA precursors

| miRNA SEQ ID NO. | pre-miRNA SEQ ID NO. | Nucleotide position of miRNA in pre-miRNA from | to |
|---|---|---|---|
| 3893 | 4772 | 37 | 57 |
| 3894 | 4458 | 11 | 32 |
| 3894 | 4464 | 11 | 32 |
| 3895 | 5006 | 11 | 34 |
| 3896 | 4399 | 11 | 30 |
| 3897 | 4999 | 46 | 65 |
| 3898 | 5110 | 57 | 79 |
| 3899 | 5152 | 54 | 75 |
| 3900 | 4710 | 41 | 62 |
| 3901 | 4199 | 42 | 61 |
| 3902 | 4872 | 74 | 97 |
| 3903 | 4782 | 36 | 56 |
| 3904 | 4771 | 102 | 121 |
| 3905 | 4573 | 11 | 30 |
| 3905 | 4824 | 11 | 30 |
| 3905 | 4713 | 11 | 30 |
| 3905 | 4734 | 11 | 30 |
| 3905 | 4596 | 11 | 30 |
| 3905 | 4707 | 11 | 30 |
| 3905 | 4583 | 11 | 30 |
| 3906 | 4842 | 11 | 30 |
| 3906 | 5085 | 11 | 30 |
| 3907 | 5061 | 11 | 31 |
| 3908 | 5197 | 38 | 58 |
| 3909 | 4846 | 79 | 99 |
| 3910 | 4169 | 11 | 33 |
| 3911 | 5190 | 11 | 32 |
| 3912 | 4704 | 11 | 33 |
| 3912 | 4763 | 11 | 33 |
| 3913 | 4531 | 37 | 56 |
| 3914 | 4737 | 11 | 32 |
| 3915 | 4814 | 11 | 33 |
| 3916 | 5221 | 132 | 153 |
| 3916 | 5247 | 132 | 153 |
| 3917 | 4390 | 33 | 53 |
| 3918 | 4138 | 173 | 196 |
| 3919 | 4677 | 42 | 64 |
| 3920 | 4171 | 11 | 34 |
| 3920 | 4309 | 11 | 34 |
| 3921 | 5031 | 64 | 87 |

Example 5

This example describes additional non-limiting embodiments of crop plant their precursor (foldback) structures, useful in making recombinant DNA invention.

Figure 6:
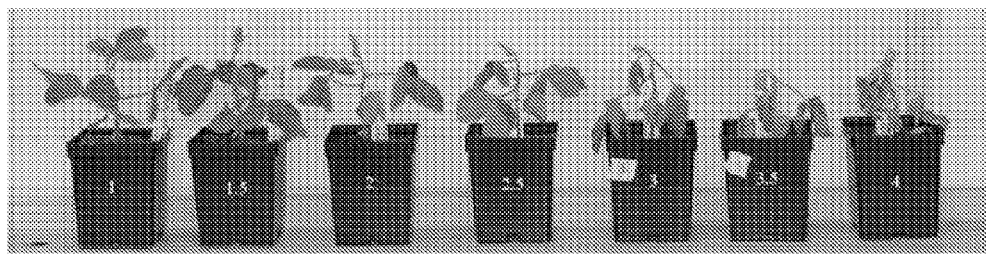
FIG. 6 depicts drought stages for soybean plants a relative scoring system from 1.0 (no effect or control) to 4.0, as described in Example 5.

Small-RNA libraries were prepared from maize (corn, *Zea mays*) or from soybean (*Glycine max*) grown under water stress and control conditions (Table 5). Drought stages for soybean were assessed using a relative scoring system from 1.0 (no effect or control) to 4.0; examples of soybean plants at each stage are illustrated in FIG. 6. The small RNA sequences thus obtained were used for predicting additional novel microRNAs and their precursor (foldback) structures from maize or soybean genomic sequences, respectively, using the procedures described above in Example 1. From maize, 1186 maize miRNAs were predicted in 1725 maize genomic sequences, and from soybean, 134 soybean miRNAs are predicted in 181 soybean genomic sequences (Table 6). These miRNAs and their corresponding miRNA precursor sequences, as well as the nucleotide position of the mature miRNA in each miRNA precursor sequence, are referred to by their respective sequence identification numbers in Table 6 as follows: maize miRNAs (SEQ ID NOS. 5498-6683), corn miRNA precursor sequences (SEQ ID NOS. 6684-8408), soybean miRNAs (SEQ ID NOS. 8409-8560), and soybean miRNA precursor sequences (SEQ ID NOS. 8561-8741).

TABLE 5

| Library Number | Crop Plant | Tissue | Developmental stage | Treatment |
|---|---|---|---|---|
| 42 | maize (*Zea mays*) | young sink leaf | V8 | control |
| 43 | maize (*Zea mays*) | young sink leaf | V8 | mild drought |
| 44 | maize (*Zea mays*) | young sink leaf | V8 | control |
| 45 | maize (*Zea mays*) | young sink leaf | V8 | severe drought |
| 46 | maize (*Zea mays*) | root | V8 | control |
| 47 | maize (*Zea mays*) | root | V8 | mild drought |
| 48 | maize (*Zea mays*) | root | V8 | control |
| 38 | soybean (*Glycine max*) | seedling leaf | seedling | control |
| 39 | soybean (*Glycine max*) | pooled seedling leaf | seedling | drought, stage 3.0 and 3.5 pooled* |
| 40 | soybean (*Glycine max*) | root | mature | control |
| 41 | soybean (*Glycine max*) | pooled root mature | mature | drought, all stages 1.5 through 3.5 pooled* |

*For libraries 39 and 41 prepared from soybean, samples from the stages indicated were pooled; drought stages for soybean are assessed using a relative scoring system as follows:
1.0 = no effect
1.5 = meristem or one trifoliate wilted
2.0 = two trifoliates wilted
2.5 = all trifoliates wilted
3.0 = bottom trifoliate completely dried out and brittle
3.5 = all trifoliates but the top one completely dried out and brittle, top trifoliate still soft
4.0 = all completely dried out and brittle

TABLE 6

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 5498 | 8176 | 11 | 34 |
| 5499 | 7089 | 11 | 34 |
| 5500 | 6978 | 99 | 119 |
| 5500 | 8029 | 97 | 117 |
| 5500 | 8030 | 97 | 117 |
| 5500 | 8195 | 99 | 119 |
| 5500 | 8205 | 99 | 119 |
| 5500 | 8236 | 99 | 119 |
| 5501 | 7554 | 143 | 164 |
| 5502 | 7902 | 11 | 34 |
| 5503 | 6723 | 57 | 80 |
| 5503 | 7359 | 11 | 34 |
| 5504 | 7087 | 11 | 34 |
| 5504 | 8156 | 11 | 34 |
| 5505 | 7303 | 62 | 85 |
| 5506 | 8120 | 35 | 56 |
| 5507 | 8047 | 11 | 32 |
| 5508 | 6970 | 5 | 28 |
| 5509 | 7685 | 74 | 97 |
| 5510 | 6881 | 63 | 84 |
| 5511 | 7068 | 70 | 91 |
| 5511 | 8217 | 69 | 90 |
| 5512 | 7772 | 55 | 74 |
| 5513 | 7585 | 11 | 34 |
| 5514 | 7009 | 42 | 61 |
| 5514 | 7335 | 42 | 61 |
| 5514 | 7912 | 42 | 61 |
| 5514 | 8272 | 42 | 61 |
| 5514 | 8354 | 42 | 61 |
| 5515 | 8130 | 11 | 32 |
| 5516 | 7085 | 55 | 77 |
| 5517 | 7845 | 11 | 32 |
| 5518 | 8270 | 135 | 158 |
| 5519 | 7363 | 50 | 69 |
| 5520 | 7853 | 11 | 32 |
| 5520 | 8147 | 11 | 32 |
| 5521 | 7710 | 11 | 30 |
| 5522 | 7521 | 2 | 25 |
| 5522 | 7655 | 187 | 210 |
| 5523 | 7152 | 11 | 34 |
| 5524 | 6774 | 145 | 167 |
| 5525 | 6790 | 159 | 179 |
| 5526 | 7947 | 11 | 34 |
| 5527 | 7744 | 6 | 25 |
| 5528 | 7233 | 11 | 32 |
| 5529 | 7476 | 11 | 30 |
| 5530 | 7933 | 11 | 33 |
| 5531 | 7971 | 11 | 34 |
| 5532 | 6815 | 11 | 34 |
| 5533 | 8034 | 41 | 63 |
| 5534 | 6824 | 11 | 31 |
| 5535 | 6912 | 136 | 155 |
| 5535 | 7220 | 137 | 156 |
| 5535 | 7779 | 140 | 159 |
| 5536 | 7920 | 45 | 65 |
| 5537 | 7921 | 11 | 35 |
| 5538 | 8284 | 11 | 31 |
| 5539 | 6829 | 143 | 164 |
| 5539 | 6864 | 11 | 32 |
| 5539 | 6905 | 11 | 32 |
| 5539 | 6952 | 144 | 165 |
| 5539 | 7709 | 11 | 32 |
| 5540 | 7045 | 91 | 115 |
| 5540 | 7207 | 91 | 115 |
| 5540 | 7641 | 91 | 115 |
| 5540 | 7834 | 91 | 115 |
| 5540 | 7835 | 91 | 115 |
| 5541 | 8303 | 11 | 31 |
| 5542 | 8230 | 109 | 132 |
| 5543 | 7839 | 34 | 55 |
| 5543 | 7840 | 34 | 55 |
| 5544 | 6856 | 11 | 34 |
| 5545 | 6686 | 204 | 224 |
| 5545 | 7092 | 199 | 219 |
| 5546 | 7888 | 38 | 61 |
| 5547 | 7293 | 11 | 34 |
| 5548 | 7871 | 11 | 32 |
| 5549 | 7979 | 39 | 62 |
| 5550 | 7324 | 11 | 34 |
| 5550 | 7922 | 157 | 180 |
| 5551 | 7691 | 45 | 68 |
| 5552 | 8233 | 40 | 63 |
| 5553 | 7170 | 47 | 70 |
| 5554 | 8390 | 36 | 59 |
| 5555 | 7177 | 11 | 31 |
| 5556 | 7525 | 61 | 81 |
| 5557 | 6991 | 39 | 62 |
| 5558 | 7879 | 111 | 132 |
| 5559 | 7627 | 11 | 32 |
| 5560 | 7485 | 11 | 34 |
| 5560 | 7565 | 40 | 63 |
| 5560 | 8056 | 11 | 34 |
| 5561 | 6690 | 11 | 34 |
| 5562 | 6832 | 54 | 75 |
| 5563 | 7459 | 45 | 65 |
| 5563 | 7460 | 45 | 65 |
| 5563 | 7507 | 46 | 66 |
| 5563 | 7730 | 45 | 65 |
| 5563 | 7756 | 46 | 66 |
| 5563 | 8058 | 46 | 66 |
| 5563 | 8064 | 47 | 67 |
| 5563 | 8065 | 46 | 66 |
| 5564 | 7571 | 47 | 70 |
| 5565 | 7030 | 11 | 30 |
| 5566 | 7059 | 11 | 34 |
| 5566 | 7514 | 11 | 34 |
| 5566 | 8111 | 11 | 34 |
| 5566 | 8215 | 11 | 34 |
| 5566 | 8337 | 11 | 34 |
| 5567 | 6748 | 66 | 89 |
| 5568 | 6725 | 97 | 117 |
| 5568 | 6830 | 97 | 117 |
| 5568 | 8307 | 11 | 31 |
| 5569 | 7287 | 11 | 31 |
| 5570 | 6778 | 11 | 31 |
| 5570 | 8172 | 213 | 233 |
| 5571 | 7882 | 45 | 66 |
| 5572 | 7227 | 56 | 79 |
| 5573 | 7491 | 33 | 56 |
| 5574 | 7296 | 122 | 142 |
| 5575 | 7614 | 11 | 34 |
| 5576 | 6793 | 112 | 132 |
| 5577 | 6741 | 40 | 63 |
| 5577 | 6942 | 39 | 62 |
| 5577 | 7057 | 40 | 63 |
| 5577 | 7206 | 39 | 62 |
| 5577 | 7381 | 40 | 63 |
| 5577 | 7388 | 39 | 62 |
| 5577 | 7423 | 40 | 63 |
| 5577 | 7427 | 39 | 62 |
| 5577 | 7504 | 40 | 63 |
| 5577 | 7907 | 39 | 62 |
| 5577 | 7956 | 40 | 63 |
| 5577 | 7958 | 39 | 62 |
| 5577 | 7965 | 39 | 62 |
| 5577 | 7966 | 40 | 63 |
| 5577 | 7997 | 39 | 62 |
| 5577 | 8011 | 40 | 63 |
| 5577 | 8025 | 40 | 63 |
| 5577 | 8170 | 39 | 62 |
| 5577 | 8185 | 39 | 62 |
| 5577 | 8312 | 40 | 63 |
| 5578 | 7978 | 58 | 81 |
| 5578 | 8131 | 58 | 81 |
| 5579 | 7430 | 62 | 83 |
| 5579 | 7442 | 62 | 83 |

TABLE 6-continued

Maize and soybean miRNAs and miRNA precursors

| miRNA SEQ ID NO. | pre-miRNA SEQ ID NO. | Nucleotide position of miRNA in pre-miRNA | |
|---|---|---|---|
| | | from | to |
| 5579 | 7698 | 62 | 83 |
| 5580 | 7914 | 55 | 78 |
| 5581 | 6869 | 113 | 136 |
| 5582 | 7396 | 11 | 34 |
| 5583 | 7668 | 11 | 31 |
| 5584 | 6762 | 80 | 103 |
| 5585 | 7937 | 11 | 30 |
| 5586 | 8175 | 11 | 31 |
| 5587 | 7477 | 73 | 96 |
| 5588 | 8180 | 37 | 60 |
| 5589 | 7934 | 35 | 58 |
| 5590 | 7517 | 123 | 146 |
| 5591 | 7566 | 11 | 34 |
| 5592 | 7781 | 11 | 32 |
| 5593 | 7760 | 87 | 110 |
| 5594 | 7223 | 11 | 31 |
| 5594 | 7417 | 11 | 31 |
| 5594 | 7496 | 11 | 31 |
| 5594 | 7816 | 11 | 31 |
| 5594 | 7872 | 11 | 31 |
| 5594 | 7897 | 11 | 31 |
| 5594 | 8024 | 11 | 31 |
| 5594 | 8026 | 11 | 31 |
| 5595 | 6958 | 40 | 63 |
| 5595 | 8016 | 11 | 34 |
| 5596 | 8285 | 76 | 99 |
| 5597 | 8125 | 11 | 34 |
| 5598 | 8008 | 42 | 63 |
| 5599 | 7414 | 38 | 61 |
| 5600 | 6708 | 74 | 93 |
| 5600 | 8041 | 11 | 30 |
| 5600 | 8042 | 11 | 30 |
| 5601 | 7823 | 11 | 34 |
| 5602 | 7483 | 338 | 359 |
| 5603 | 6685 | 71 | 91 |
| 5603 | 7780 | 102 | 122 |
| 5604 | 7072 | 118 | 138 |
| 5605 | 7893 | 11 | 31 |
| 5606 | 7646 | 70 | 92 |
| 5607 | 8348 | 104 | 127 |
| 5608 | 7290 | 60 | 80 |
| 5609 | 7670 | 189 | 212 |
| 5610 | 6949 | 92 | 112 |
| 5611 | 6870 | 39 | 61 |
| 5611 | 6878 | 218 | 240 |
| 5611 | 7243 | 218 | 240 |
| 5611 | 8235 | 39 | 61 |
| 5612 | 7546 | 11 | 32 |
| 5613 | 8264 | 11 | 34 |
| 5614 | 7829 | 11 | 31 |
| 5614 | 8314 | 11 | 31 |
| 5615 | 6760 | 11 | 31 |
| 5616 | 7310 | 51 | 71 |
| 5617 | 7373 | 11 | 32 |
| 5618 | 7440 | 11 | 34 |
| 5619 | 7475 | 211 | 234 |
| 5620 | 8356 | 404 | 423 |
| 5621 | 7715 | 11 | 32 |
| 5622 | 6993 | 99 | 122 |
| 5623 | 7841 | 11 | 31 |
| 5624 | 7183 | 81 | 101 |
| 5625 | 6861 | 35 | 55 |
| 5626 | 8122 | 11 | 34 |
| 5627 | 6767 | 11 | 33 |
| 5627 | 7919 | 11 | 33 |
| 5628 | 6957 | 11 | 34 |
| 5629 | 7383 | 73 | 95 |
| 5629 | 7634 | 73 | 95 |
| 5630 | 7809 | 38 | 59 |
| 5630 | 7810 | 37 | 58 |
| 5630 | 7936 | 38 | 59 |
| 5631 | 7140 | 40 | 61 |
| 5631 | 7197 | 40 | 61 |
| 5632 | 6730 | 215 | 234 |
| 5632 | 7754 | 218 | 237 |
| 5633 | 7577 | 134 | 153 |
| 5633 | 7613 | 134 | 153 |
| 5634 | 7003 | 72 | 91 |
| 5635 | 7812 | 11 | 30 |
| 5636 | 8049 | 60 | 83 |
| 5637 | 8375 | 11 | 33 |
| 5638 | 8164 | 11 | 31 |
| 5639 | 7573 | 37 | 56 |
| 5640 | 8259 | 11 | 34 |
| 5641 | 7240 | 11 | 30 |
| 5642 | 8128 | 222 | 245 |
| 5643 | 7660 | 11 | 32 |
| 5644 | 6804 | 37 | 59 |
| 5644 | 6924 | 37 | 59 |
| 5644 | 7138 | 37 | 59 |
| 5644 | 7439 | 37 | 59 |
| 5644 | 7450 | 37 | 59 |
| 5644 | 7588 | 37 | 59 |
| 5644 | 7591 | 37 | 59 |
| 5644 | 7786 | 37 | 59 |
| 5644 | 7905 | 37 | 59 |
| 5644 | 7928 | 37 | 59 |
| 5645 | 8204 | 38 | 60 |
| 5646 | 6687 | 187 | 209 |
| 5647 | 7330 | 11 | 32 |
| 5648 | 7587 | 11 | 34 |
| 5649 | 7435 | 292 | 315 |
| 5650 | 7653 | 11 | 34 |
| 5650 | 8066 | 11 | 34 |
| 5651 | 7055 | 11 | 33 |
| 5651 | 7763 | 11 | 33 |
| 5652 | 7755 | 11 | 34 |
| 5652 | 7828 | 11 | 34 |
| 5653 | 8115 | 32 | 51 |
| 5654 | 7821 | 48 | 71 |
| 5655 | 6694 | 11 | 33 |
| 5656 | 6990 | 11 | 31 |
| 5656 | 7793 | 11 | 31 |
| 5657 | 8250 | 11 | 30 |
| 5658 | 8080 | 11 | 34 |
| 5659 | 7394 | 11 | 34 |
| 5660 | 8305 | 11 | 31 |
| 5661 | 6873 | 11 | 31 |
| 5662 | 7264 | 51 | 74 |
| 5662 | 8287 | 11 | 34 |
| 5663 | 7001 | 11 | 32 |
| 5664 | 8394 | 11 | 34 |
| 5665 | 7406 | 78 | 97 |
| 5665 | 7470 | 11 | 30 |
| 5666 | 7144 | 41 | 62 |
| 5666 | 7635 | 41 | 62 |
| 5667 | 6698 | 11 | 34 |
| 5668 | 7117 | 11 | 32 |
| 5668 | 7154 | 11 | 32 |
| 5668 | 7457 | 11 | 32 |
| 5669 | 8135 | 117 | 137 |
| 5670 | 6906 | 58 | 78 |
| 5671 | 7167 | 11 | 34 |
| 5672 | 7217 | 165 | 184 |
| 5672 | 7326 | 165 | 184 |
| 5673 | 6977 | 66 | 85 |
| 5674 | 7526 | 130 | 149 |
| 5675 | 7820 | 11 | 32 |
| 5676 | 7765 | 11 | 34 |
| 5677 | 7110 | 48 | 69 |
| 5678 | 7319 | 11 | 35 |
| 5679 | 8171 | 46 | 65 |
| 5679 | 8241 | 46 | 65 |
| 5680 | 7555 | 31 | 54 |
| 5680 | 8143 | 31 | 54 |
| 5681 | 6707 | 11 | 31 |

TABLE 6-continued

Maize and soybean miRNAs and miRNA precursors

| miRNA SEQ ID NO. | pre-miRNA SEQ ID NO. | Nucleotide position of miRNA in pre-miRNA | |
|---|---|---|---|
| | | from | to |
| 5682 | 8129 | 1 | 22 |
| 5683 | 7060 | 11 | 31 |
| 5683 | 7078 | 52 | 72 |
| 5684 | 7802 | 11 | 34 |
| 5685 | 7356 | 11 | 34 |
| 5686 | 6847 | 11 | 34 |
| 5687 | 8326 | 11 | 31 |
| 5688 | 7314 | 144 | 164 |
| 5689 | 7512 | 11 | 34 |
| 5690 | 8193 | 157 | 177 |
| 5691 | 8210 | 11 | 34 |
| 5692 | 7323 | 47 | 69 |
| 5693 | 8278 | 11 | 34 |
| 5694 | 8393 | 69 | 89 |
| 5695 | 8004 | 70 | 91 |
| 5696 | 6765 | 36 | 55 |
| 5696 | 7556 | 36 | 55 |
| 5696 | 7771 | 36 | 55 |
| 5697 | 7601 | 83 | 104 |
| 5698 | 7266 | 11 | 35 |
| 5699 | 7873 | 137 | 157 |
| 5700 | 7093 | 11 | 34 |
| 5701 | 7034 | 11 | 30 |
| 5701 | 7246 | 11 | 30 |
| 5702 | 6968 | 56 | 79 |
| 5703 | 7469 | 42 | 63 |
| 5704 | 7891 | 11 | 34 |
| 5705 | 8166 | 11 | 31 |
| 5706 | 7295 | 58 | 78 |
| 5707 | 7752 | 11 | 32 |
| 5708 | 6909 | 11 | 34 |
| 5708 | 7581 | 97 | 120 |
| 5709 | 8155 | 55 | 75 |
| 5710 | 7704 | 11 | 33 |
| 5711 | 8032 | 11 | 31 |
| 5712 | 7868 | 11 | 34 |
| 5712 | 7869 | 11 | 34 |
| 5713 | 6766 | 42 | 62 |
| 5714 | 7644 | 11 | 34 |
| 5715 | 7132 | 75 | 98 |
| 5715 | 7245 | 11 | 34 |
| 5715 | 8276 | 11 | 34 |
| 5715 | 8344 | 11 | 34 |
| 5716 | 6781 | 11 | 33 |
| 5717 | 6754 | 11 | 35 |
| 5718 | 7358 | 11 | 31 |
| 5718 | 8178 | 11 | 31 |
| 5719 | 7895 | 29 | 49 |
| 5720 | 7813 | 11 | 31 |
| 5721 | 7631 | 11 | 31 |
| 5722 | 7105 | 11 | 31 |
| 5723 | 7063 | 42 | 61 |
| 5723 | 7163 | 42 | 61 |
| 5723 | 8308 | 42 | 61 |
| 5724 | 6734 | 11 | 32 |
| 5724 | 7121 | 11 | 32 |
| 5724 | 7632 | 11 | 32 |
| 5725 | 8046 | 11 | 32 |
| 5725 | 8396 | 11 | 32 |
| 5726 | 7836 | 211 | 232 |
| 5727 | 8148 | 11 | 34 |
| 5727 | 8149 | 49 | 72 |
| 5728 | 7175 | 11 | 33 |
| 5729 | 7134 | 11 | 34 |
| 5730 | 6858 | 86 | 108 |
| 5731 | 6836 | 11 | 33 |
| 5732 | 7910 | 107 | 126 |
| 5733 | 6884 | 233 | 256 |
| 5734 | 7010 | 11 | 30 |
| 5735 | 8158 | 11 | 30 |
| 5736 | 6989 | 11 | 33 |
| 5737 | 7964 | 11 | 34 |
| 5738 | 7041 | 76 | 97 |
| 5738 | 8268 | 75 | 96 |
| 5739 | 6850 | 11 | 32 |
| 5740 | 6724 | 182 | 204 |
| 5740 | 8209 | 84 | 106 |
| 5741 | 7193 | 181 | 204 |
| 5741 | 7194 | 191 | 214 |
| 5741 | 7798 | 181 | 204 |
| 5742 | 7354 | 83 | 104 |
| 5743 | 6716 | 50 | 73 |
| 5743 | 6736 | 11 | 34 |
| 5744 | 7253 | 240 | 262 |
| 5745 | 8084 | 97 | 120 |
| 5746 | 6853 | 113 | 133 |
| 5747 | 7564 | 11 | 31 |
| 5747 | 8330 | 11 | 31 |
| 5748 | 7166 | 11 | 34 |
| 5749 | 7182 | 96 | 116 |
| 5750 | 8222 | 211 | 231 |
| 5751 | 6860 | 178 | 199 |
| 5752 | 7018 | 11 | 34 |
| 5753 | 7026 | 11 | 31 |
| 5754 | 7484 | 124 | 145 |
| 5755 | 8255 | 11 | 31 |
| 5756 | 7944 | 11 | 34 |
| 5757 | 7297 | 11 | 34 |
| 5758 | 7650 | 11 | 30 |
| 5759 | 8174 | 46 | 67 |
| 5760 | 7474 | 11 | 34 |
| 5760 | 7510 | 11 | 34 |
| 5760 | 7511 | 11 | 34 |
| 5761 | 7360 | 11 | 30 |
| 5761 | 8246 | 11 | 30 |
| 5762 | 8403 | 29 | 52 |
| 5763 | 7005 | 64 | 86 |
| 5764 | 8310 | 11 | 33 |
| 5765 | 6894 | 3 | 24 |
| 5766 | 7558 | 46 | 67 |
| 5767 | 7520 | 232 | 252 |
| 5767 | 8017 | 148 | 168 |
| 5767 | 8100 | 70 | 90 |
| 5768 | 7611 | 236 | 255 |
| 5769 | 8345 | 107 | 127 |
| 5770 | 7025 | 11 | 31 |
| 5771 | 7143 | 11 | 34 |
| 5772 | 7447 | 11 | 32 |
| 5773 | 7590 | 11 | 34 |
| 5774 | 6739 | 152 | 175 |
| 5774 | 7669 | 151 | 174 |
| 5774 | 8013 | 152 | 175 |
| 5775 | 6720 | 11 | 32 |
| 5775 | 7165 | 11 | 32 |
| 5775 | 7638 | 11 | 32 |
| 5775 | 8377 | 11 | 32 |
| 5776 | 7686 | 74 | 97 |
| 5777 | 7340 | 11 | 32 |
| 5777 | 7397 | 11 | 32 |
| 5777 | 8239 | 77 | 98 |
| 5778 | 8192 | 11 | 30 |
| 5779 | 8048 | 11 | 34 |
| 5780 | 7239 | 78 | 101 |
| 5781 | 7945 | 11 | 31 |
| 5782 | 8408 | 11 | 31 |
| 5783 | 8057 | 11 | 30 |
| 5784 | 7204 | 237 | 256 |
| 5785 | 7599 | 135 | 158 |
| 5786 | 6921 | 11 | 31 |
| 5787 | 7677 | 11 | 31 |
| 5788 | 8124 | 55 | 76 |
| 5789 | 7817 | 11 | 32 |
| 5790 | 6934 | 11 | 32 |
| 5790 | 7015 | 11 | 32 |
| 5790 | 7124 | 11 | 32 |
| 5790 | 7317 | 11 | 32 |

TABLE 6-continued

Maize and soybean miRNAs and miRNA precursors

| miRNA SEQ ID NO. | pre-miRNA SEQ ID NO. | Nucleotide position of miRNA in pre-miRNA | |
|---|---|---|---|
| | | from | to |
| 5790 | 7428 | 11 | 32 |
| 5790 | 7488 | 11 | 32 |
| 5790 | 7532 | 11 | 32 |
| 5790 | 7575 | 11 | 32 |
| 5790 | 7576 | 11 | 32 |
| 5790 | 7665 | 11 | 32 |
| 5791 | 7738 | 11 | 34 |
| 5792 | 7040 | 44 | 68 |
| 5793 | 7530 | 11 | 33 |
| 5794 | 7076 | 47 | 70 |
| 5795 | 7988 | 3 | 23 |
| 5796 | 6718 | 52 | 75 |
| 5797 | 7336 | 184 | 204 |
| 5798 | 7073 | 43 | 64 |
| 5798 | 8001 | 33 | 54 |
| 5799 | 7499 | 11 | 32 |
| 5800 | 8385 | 218 | 238 |
| 5801 | 6865 | 117 | 137 |
| 5801 | 7524 | 117 | 137 |
| 5802 | 7037 | 96 | 117 |
| 5803 | 7822 | 36 | 56 |
| 5804 | 8145 | 114 | 137 |
| 5805 | 7398 | 36 | 59 |
| 5806 | 7992 | 11 | 34 |
| 5807 | 6820 | 40 | 63 |
| 5808 | 7205 | 82 | 103 |
| 5809 | 7899 | 11 | 34 |
| 5810 | 7490 | 58 | 81 |
| 5811 | 6833 | 11 | 32 |
| 5811 | 7727 | 11 | 32 |
| 5812 | 7408 | 11 | 31 |
| 5813 | 6848 | 11 | 31 |
| 5814 | 6941 | 192 | 211 |
| 5815 | 7069 | 37 | 58 |
| 5815 | 8368 | 37 | 58 |
| 5816 | 8357 | 11 | 31 |
| 5817 | 8108 | 11 | 30 |
| 5818 | 7814 | 11 | 30 |
| 5819 | 7529 | 28 | 48 |
| 5819 | 8248 | 28 | 48 |
| 5820 | 6763 | 47 | 66 |
| 5821 | 8012 | 11 | 30 |
| 5821 | 8091 | 11 | 30 |
| 5822 | 8054 | 54 | 73 |
| 5823 | 7268 | 239 | 259 |
| 5824 | 6732 | 11 | 34 |
| 5824 | 6827 | 11 | 34 |
| 5824 | 7184 | 11 | 34 |
| 5825 | 8340 | 11 | 30 |
| 5826 | 7300 | 11 | 34 |
| 5827 | 8050 | 11 | 30 |
| 5828 | 8245 | 68 | 90 |
| 5829 | 7981 | 11 | 33 |
| 5829 | 7983 | 11 | 33 |
| 5830 | 7331 | 185 | 205 |
| 5831 | 7862 | 35 | 54 |
| 5832 | 7642 | 57 | 80 |
| 5832 | 8266 | 57 | 80 |
| 5833 | 8247 | 40 | 61 |
| 5834 | 7931 | 11 | 30 |
| 5834 | 8359 | 11 | 30 |
| 5835 | 7697 | 35 | 56 |
| 5836 | 7759 | 11 | 33 |
| 5837 | 8187 | 41 | 64 |
| 5838 | 7279 | 44 | 63 |
| 5839 | 8038 | 189 | 210 |
| 5839 | 8200 | 189 | 210 |
| 5840 | 7860 | 2 | 22 |
| 5841 | 6959 | 11 | 34 |
| 5841 | 7462 | 11 | 34 |
| 5842 | 6784 | 52 | 71 |
| 5842 | 8378 | 11 | 30 |
| 5843 | 6772 | 73 | 96 |
| 5843 | 7181 | 73 | 96 |
| 5844 | 7932 | 155 | 178 |
| 5845 | 8074 | 11 | 32 |
| 5846 | 8306 | 11 | 30 |
| 5847 | 7202 | 38 | 61 |
| 5848 | 6780 | 41 | 61 |
| 5849 | 7833 | 11 | 34 |
| 5850 | 7619 | 11 | 31 |
| 5851 | 6819 | 11 | 34 |
| 5851 | 7274 | 38 | 61 |
| 5851 | 8144 | 38 | 61 |
| 5851 | 8386 | 38 | 61 |
| 5852 | 6787 | 34 | 55 |
| 5852 | 8189 | 34 | 55 |
| 5853 | 7247 | 11 | 31 |
| 5854 | 6938 | 143 | 164 |
| 5855 | 7191 | 168 | 188 |
| 5855 | 7316 | 168 | 188 |
| 5856 | 7737 | 76 | 97 |
| 5857 | 7918 | 44 | 67 |
| 5858 | 7551 | 11 | 34 |
| 5859 | 7774 | 11 | 34 |
| 5860 | 7375 | 11 | 33 |
| 5861 | 7745 | 132 | 152 |
| 5862 | 8211 | 181 | 203 |
| 5863 | 7652 | 132 | 155 |
| 5864 | 7355 | 11 | 33 |
| 5865 | 7927 | 42 | 61 |
| 5866 | 7434 | 196 | 218 |
| 5867 | 8039 | 67 | 86 |
| 5868 | 6731 | 11 | 34 |
| 5869 | 6929 | 63 | 84 |
| 5870 | 7864 | 7 | 27 |
| 5871 | 8133 | 30 | 50 |
| 5872 | 8292 | 211 | 230 |
| 5873 | 7226 | 11 | 34 |
| 5874 | 7237 | 66 | 89 |
| 5875 | 8079 | 11 | 33 |
| 5876 | 7508 | 172 | 191 |
| 5876 | 7913 | 159 | 178 |
| 5877 | 8263 | 137 | 161 |
| 5878 | 8083 | 11 | 32 |
| 5879 | 8087 | 11 | 30 |
| 5880 | 7705 | 49 | 72 |
| 5881 | 7262 | 11 | 31 |
| 5881 | 7277 | 11 | 31 |
| 5881 | 8194 | 11 | 31 |
| 5882 | 7664 | 53 | 72 |
| 5883 | 6849 | 36 | 55 |
| 5883 | 7410 | 11 | 30 |
| 5884 | 7874 | 11 | 32 |
| 5885 | 6948 | 11 | 32 |
| 5886 | 6756 | 11 | 31 |
| 5886 | 6837 | 11 | 31 |
| 5886 | 7016 | 11 | 31 |
| 5886 | 7654 | 11 | 31 |
| 5887 | 8159 | 48 | 68 |
| 5888 | 7948 | 79 | 98 |
| 5889 | 7353 | 32 | 52 |
| 5890 | 6972 | 57 | 77 |
| 5891 | 8275 | 11 | 31 |
| 5892 | 7020 | 11 | 34 |
| 5893 | 7625 | 11 | 31 |
| 5894 | 7606 | 41 | 60 |
| 5894 | 7608 | 9 | 28 |
| 5895 | 6809 | 11 | 34 |
| 5896 | 6823 | 98 | 120 |
| 5896 | 6893 | 98 | 120 |
| 5896 | 7848 | 100 | 122 |
| 5897 | 6795 | 11 | 30 |
| 5898 | 7843 | 11 | 32 |
| 5899 | 8298 | 11 | 32 |
| 5900 | 8363 | 11 | 34 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 5901 | 7248 | 10 | 33 |
| 5902 | 7885 | 11 | 31 |
| 5903 | 6875 | 11 | 35 |
| 5904 | 6975 | 112 | 133 |
| 5905 | 7461 | 11 | 34 |
| 5906 | 6951 | 46 | 69 |
| 5907 | 6877 | 11 | 35 |
| 5907 | 7390 | 11 | 35 |
| 5908 | 8199 | 75 | 97 |
| 5909 | 7883 | 39 | 62 |
| 5910 | 7088 | 85 | 108 |
| 5911 | 6709 | 11 | 34 |
| 5912 | 7265 | 30 | 50 |
| 5912 | 7663 | 30 | 50 |
| 5912 | 8339 | 30 | 50 |
| 5913 | 6885 | 221 | 244 |
| 5914 | 8406 | 11 | 30 |
| 5915 | 7550 | 11 | 34 |
| 5916 | 7804 | 75 | 98 |
| 5917 | 8327 | 60 | 83 |
| 5918 | 7487 | 11 | 34 |
| 5919 | 7681 | 44 | 65 |
| 5920 | 7012 | 115 | 136 |
| 5921 | 7256 | 11 | 34 |
| 5922 | 7000 | 42 | 66 |
| 5923 | 8367 | 11 | 31 |
| 5924 | 6919 | 11 | 34 |
| 5925 | 7749 | 36 | 55 |
| 5926 | 8352 | 11 | 30 |
| 5927 | 7838 | 11 | 32 |
| 5928 | 7074 | 38 | 57 |
| 5928 | 8063 | 38 | 57 |
| 5929 | 6826 | 40 | 60 |
| 5930 | 8109 | 125 | 144 |
| 5931 | 8387 | 76 | 96 |
| 5932 | 7042 | 11 | 31 |
| 5932 | 7049 | 11 | 31 |
| 5932 | 7210 | 11 | 31 |
| 5932 | 7875 | 11 | 31 |
| 5933 | 6764 | 11 | 31 |
| 5933 | 8365 | 11 | 31 |
| 5934 | 8202 | 115 | 136 |
| 5935 | 7991 | 11 | 30 |
| 5936 | 7118 | 11 | 31 |
| 5936 | 7850 | 11 | 31 |
| 5936 | 7851 | 11 | 31 |
| 5936 | 8141 | 11 | 31 |
| 5936 | 8213 | 11 | 31 |
| 5936 | 8228 | 11 | 31 |
| 5937 | 7115 | 11 | 32 |
| 5938 | 6713 | 11 | 30 |
| 5938 | 6947 | 11 | 30 |
| 5939 | 6976 | 134 | 155 |
| 5940 | 6984 | 11 | 34 |
| 5941 | 7857 | 11 | 32 |
| 5941 | 8075 | 11 | 32 |
| 5942 | 7713 | 38 | 57 |
| 5943 | 7622 | 50 | 69 |
| 5944 | 6852 | 11 | 31 |
| 5945 | 7528 | 11 | 33 |
| 5946 | 7954 | 54 | 74 |
| 5947 | 8198 | 11 | 34 |
| 5948 | 6910 | 236 | 257 |
| 5949 | 7975 | 11 | 31 |
| 5950 | 7844 | 230 | 251 |
| 5951 | 8094 | 73 | 93 |
| 5952 | 6892 | 11 | 31 |
| 5953 | 6703 | 130 | 151 |
| 5953 | 6789 | 130 | 151 |
| 5954 | 7127 | 11 | 33 |
| 5955 | 7728 | 73 | 96 |
| 5955 | 8208 | 73 | 96 |
| 5956 | 7801 | 52 | 74 |
| 5957 | 7612 | 11 | 31 |
| 5958 | 7213 | 33 | 52 |
| 5958 | 7768 | 33 | 52 |
| 5959 | 6786 | 40 | 60 |
| 5960 | 7633 | 11 | 32 |
| 5961 | 7790 | 11 | 31 |
| 5961 | 7950 | 11 | 31 |
| 5962 | 7351 | 11 | 34 |
| 5963 | 6995 | 54 | 77 |
| 5964 | 8027 | 42 | 65 |
| 5964 | 8347 | 42 | 65 |
| 5965 | 7466 | 108 | 127 |
| 5966 | 7500 | 11 | 34 |
| 5967 | 7495 | 49 | 69 |
| 5968 | 7463 | 80 | 104 |
| 5968 | 8296 | 80 | 104 |
| 5969 | 7156 | 11 | 31 |
| 5969 | 7377 | 39 | 59 |
| 5970 | 8099 | 52 | 75 |
| 5971 | 6821 | 11 | 34 |
| 5971 | 7549 | 198 | 221 |
| 5971 | 7807 | 198 | 221 |
| 5971 | 7880 | 198 | 221 |
| 5972 | 8253 | 11 | 35 |
| 5973 | 8154 | 107 | 130 |
| 5974 | 8214 | 11 | 31 |
| 5975 | 7986 | 11 | 32 |
| 5976 | 7150 | 89 | 109 |
| 5977 | 7723 | 42 | 65 |
| 5978 | 6845 | 139 | 159 |
| 5978 | 6902 | 139 | 159 |
| 5978 | 7275 | 11 | 31 |
| 5978 | 7707 | 140 | 160 |
| 5979 | 7887 | 11 | 30 |
| 5980 | 6710 | 86 | 107 |
| 5980 | 6998 | 86 | 107 |
| 5980 | 7302 | 86 | 107 |
| 5981 | 7855 | 11 | 33 |
| 5982 | 6722 | 46 | 67 |
| 5982 | 7436 | 46 | 67 |
| 5982 | 8023 | 46 | 67 |
| 5983 | 6930 | 202 | 224 |
| 5984 | 8364 | 42 | 63 |
| 5985 | 7392 | 48 | 67 |
| 5986 | 7100 | 42 | 61 |
| 5986 | 7208 | 42 | 61 |
| 5986 | 7209 | 42 | 61 |
| 5986 | 7569 | 42 | 61 |
| 5986 | 7865 | 42 | 61 |
| 5986 | 7866 | 42 | 61 |
| 5986 | 7867 | 42 | 61 |
| 5986 | 8053 | 42 | 61 |
| 5986 | 8244 | 42 | 61 |
| 5987 | 7014 | 11 | 31 |
| 5988 | 7116 | 11 | 32 |
| 5988 | 8404 | 11 | 32 |
| 5989 | 6866 | 92 | 115 |
| 5990 | 7849 | 137 | 160 |
| 5991 | 7630 | 168 | 187 |
| 5991 | 8260 | 168 | 187 |
| 5992 | 6791 | 11 | 32 |
| 5993 | 8116 | 10 | 29 |
| 5994 | 7407 | 175 | 195 |
| 5995 | 7158 | 11 | 31 |
| 5996 | 8107 | 88 | 111 |
| 5997 | 7252 | 188 | 209 |
| 5997 | 7675 | 182 | 203 |
| 5998 | 7106 | 38 | 58 |
| 5999 | 8045 | 46 | 69 |
| 6000 | 7224 | 56 | 76 |
| 6001 | 7225 | 36 | 56 |
| 6001 | 7735 | 36 | 56 |
| 6002 | 6749 | 11 | 34 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 6003 | 7273 | 64 | 83 |
| 6004 | 6983 | 56 | 79 |
| 6004 | 7832 | 56 | 79 |
| 6005 | 6859 | 119 | 141 |
| 6006 | 7692 | 11 | 32 |
| 6007 | 7773 | 36 | 55 |
| 6008 | 8096 | 11 | 32 |
| 6009 | 8146 | 80 | 99 |
| 6010 | 7133 | 236 | 256 |
| 6010 | 7568 | 204 | 224 |
| 6011 | 8078 | 11 | 34 |
| 6012 | 8092 | 241 | 261 |
| 6013 | 6816 | 211 | 232 |
| 6014 | 6817 | 11 | 35 |
| 6014 | 7909 | 11 | 35 |
| 6015 | 6705 | 35 | 55 |
| 6016 | 7379 | 45 | 68 |
| 6017 | 7762 | 68 | 92 |
| 6018 | 7027 | 11 | 35 |
| 6018 | 7173 | 11 | 35 |
| 6019 | 7819 | 11 | 32 |
| 6020 | 7192 | 11 | 35 |
| 6021 | 8119 | 11 | 32 |
| 6022 | 6911 | 30 | 49 |
| 6023 | 7031 | 11 | 31 |
| 6024 | 7232 | 11 | 32 |
| 6025 | 6840 | 173 | 194 |
| 6026 | 8062 | 160 | 180 |
| 6027 | 8035 | 54 | 78 |
| 6028 | 8186 | 11 | 33 |
| 6029 | 6880 | 39 | 59 |
| 6030 | 8076 | 33 | 53 |
| 6031 | 6992 | 11 | 30 |
| 6032 | 7230 | 119 | 141 |
| 6032 | 8229 | 11 | 33 |
| 6033 | 6798 | 57 | 76 |
| 6034 | 7064 | 201 | 222 |
| 6035 | 8383 | 65 | 86 |
| 6036 | 8289 | 11 | 34 |
| 6037 | 7082 | 11 | 31 |
| 6038 | 7648 | 48 | 70 |
| 6039 | 8407 | 200 | 220 |
| 6040 | 7095 | 54 | 77 |
| 6041 | 8163 | 11 | 34 |
| 6042 | 7501 | 45 | 69 |
| 6042 | 7580 | 45 | 69 |
| 6042 | 7962 | 45 | 69 |
| 6043 | 6955 | 11 | 31 |
| 6043 | 7446 | 11 | 31 |
| 6043 | 7515 | 11 | 31 |
| 6043 | 7543 | 11 | 31 |
| 6043 | 7617 | 11 | 31 |
| 6043 | 7618 | 11 | 31 |
| 6043 | 7726 | 11 | 31 |
| 6043 | 8098 | 11 | 31 |
| 6043 | 8290 | 11 | 31 |
| 6044 | 7086 | 11 | 34 |
| 6044 | 7306 | 11 | 34 |
| 6044 | 7736 | 11 | 34 |
| 6045 | 7620 | 231 | 252 |
| 6045 | 7906 | 231 | 252 |
| 6046 | 7321 | 11 | 33 |
| 6047 | 6967 | 11 | 31 |
| 6048 | 7101 | 11 | 30 |
| 6048 | 8333 | 11 | 30 |
| 6048 | 8362 | 11 | 30 |
| 6049 | 7216 | 11 | 30 |
| 6049 | 7706 | 11 | 30 |
| 6050 | 7481 | 11 | 33 |
| 6051 | 8040 | 11 | 33 |
| 6052 | 6807 | 11 | 31 |
| 6053 | 7431 | 11 | 32 |
| 6053 | 8203 | 11 | 32 |
| 6054 | 7218 | 11 | 34 |
| 6054 | 7968 | 11 | 34 |
| 6055 | 8043 | 38 | 57 |
| 6056 | 8336 | 11 | 30 |
| 6057 | 8225 | 11 | 33 |
| 6058 | 6818 | 52 | 71 |
| 6059 | 7996 | 11 | 34 |
| 6060 | 6918 | 11 | 32 |
| 6061 | 8090 | 11 | 32 |
| 6062 | 7021 | 11 | 30 |
| 6063 | 7441 | 51 | 71 |
| 6064 | 7667 | 385 | 408 |
| 6065 | 8273 | 50 | 72 |
| 6066 | 7046 | 11 | 34 |
| 6067 | 8021 | 31 | 50 |
| 6068 | 6769 | 100 | 121 |
| 6068 | 7033 | 100 | 121 |
| 6069 | 7438 | 49 | 71 |
| 6070 | 6931 | 42 | 63 |
| 6070 | 7930 | 42 | 63 |
| 6071 | 8384 | 11 | 30 |
| 6072 | 8349 | 11 | 30 |
| 6072 | 8350 | 11 | 30 |
| 6073 | 6944 | 11 | 30 |
| 6073 | 8315 | 11 | 30 |
| 6074 | 6862 | 11 | 30 |
| 6075 | 7748 | 11 | 32 |
| 6076 | 6974 | 73 | 93 |
| 6077 | 7393 | 11 | 31 |
| 6077 | 7680 | 11 | 31 |
| 6077 | 7732 | 11 | 31 |
| 6077 | 7859 | 11 | 31 |
| 6078 | 6750 | 211 | 230 |
| 6079 | 8376 | 11 | 30 |
| 6080 | 6792 | 11 | 33 |
| 6081 | 8281 | 11 | 32 |
| 6082 | 7552 | 11 | 30 |
| 6083 | 7168 | 47 | 70 |
| 6084 | 7443 | 45 | 68 |
| 6085 | 7061 | 11 | 31 |
| 6085 | 7583 | 35 | 55 |
| 6086 | 6738 | 40 | 60 |
| 6087 | 7367 | 11 | 34 |
| 6088 | 8399 | 11 | 32 |
| 6089 | 6752 | 36 | 59 |
| 6090 | 6863 | 11 | 31 |
| 6091 | 7806 | 11 | 30 |
| 6092 | 7308 | 51 | 73 |
| 6092 | 7688 | 51 | 73 |
| 6092 | 8301 | 51 | 73 |
| 6093 | 7539 | 11 | 33 |
| 6094 | 7380 | 58 | 79 |
| 6094 | 8293 | 58 | 79 |
| 6095 | 7135 | 11 | 31 |
| 6096 | 8257 | 11 | 34 |
| 6096 | 8291 | 11 | 34 |
| 6097 | 7129 | 34 | 53 |
| 6098 | 7747 | 11 | 31 |
| 6099 | 6943 | 86 | 106 |
| 6100 | 8182 | 11 | 34 |
| 6100 | 8221 | 11 | 34 |
| 6101 | 6904 | 11 | 32 |
| 6101 | 8254 | 11 | 32 |
| 6102 | 7972 | 118 | 142 |
| 6103 | 6693 | 11 | 32 |
| 6104 | 7190 | 82 | 101 |
| 6105 | 7673 | 11 | 34 |
| 6106 | 7142 | 11 | 34 |
| 6107 | 7892 | 11 | 31 |
| 6108 | 7672 | 34 | 53 |
| 6109 | 7628 | 11 | 31 |
| 6110 | 8282 | 11 | 33 |
| 6111 | 6935 | 11 | 30 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 6111 | 7259 | 11 | 30 |
| 6111 | 7678 | 234 | 253 |
| 6112 | 6770 | 41 | 60 |
| 6112 | 7352 | 41 | 60 |
| 6113 | 7775 | 11 | 35 |
| 6114 | 7700 | 11 | 30 |
| 6115 | 6854 | 11 | 31 |
| 6115 | 7294 | 11 | 31 |
| 6116 | 8328 | 11 | 31 |
| 6117 | 7357 | 304 | 326 |
| 6118 | 7051 | 210 | 232 |
| 6119 | 7572 | 204 | 227 |
| 6120 | 8085 | 66 | 85 |
| 6121 | 7125 | 11 | 30 |
| 6121 | 7305 | 11 | 30 |
| 6122 | 8358 | 11 | 34 |
| 6123 | 7285 | 53 | 73 |
| 6123 | 7312 | 53 | 73 |
| 6123 | 7458 | 52 | 72 |
| 6123 | 7502 | 53 | 73 |
| 6123 | 7544 | 53 | 73 |
| 6123 | 7545 | 53 | 73 |
| 6123 | 7643 | 53 | 73 |
| 6123 | 7717 | 53 | 73 |
| 6123 | 7718 | 53 | 73 |
| 6123 | 7719 | 53 | 73 |
| 6123 | 7720 | 53 | 73 |
| 6123 | 7721 | 53 | 73 |
| 6123 | 7890 | 53 | 73 |
| 6123 | 8123 | 53 | 73 |
| 6123 | 8150 | 53 | 73 |
| 6123 | 8151 | 53 | 73 |
| 6123 | 8152 | 53 | 73 |
| 6123 | 8153 | 53 | 73 |
| 6124 | 7119 | 53 | 76 |
| 6125 | 7141 | 11 | 33 |
| 6126 | 6895 | 11 | 31 |
| 6127 | 6923 | 11 | 30 |
| 6127 | 7188 | 11 | 30 |
| 6128 | 8112 | 51 | 74 |
| 6129 | 6867 | 36 | 58 |
| 6129 | 8343 | 36 | 58 |
| 6130 | 8127 | 69 | 89 |
| 6131 | 7915 | 11 | 34 |
| 6132 | 6986 | 11 | 30 |
| 6133 | 7984 | 11 | 32 |
| 6134 | 7753 | 11 | 32 |
| 6135 | 6879 | 11 | 34 |
| 6136 | 8341 | 45 | 68 |
| 6137 | 7503 | 126 | 145 |
| 6138 | 6886 | 85 | 104 |
| 6139 | 6768 | 34 | 53 |
| 6139 | 6916 | 34 | 53 |
| 6140 | 7318 | 11 | 30 |
| 6141 | 7778 | 11 | 33 |
| 6142 | 8179 | 11 | 30 |
| 6143 | 6721 | 11 | 30 |
| 6143 | 8019 | 11 | 30 |
| 6144 | 7322 | 147 | 169 |
| 6145 | 7395 | 42 | 62 |
| 6146 | 7815 | 72 | 92 |
| 6147 | 8237 | 96 | 117 |
| 6148 | 7412 | 35 | 56 |
| 6149 | 6932 | 11 | 34 |
| 6150 | 6719 | 37 | 61 |
| 6150 | 6940 | 37 | 61 |
| 6150 | 7361 | 37 | 61 |
| 6150 | 8267 | 38 | 62 |
| 6150 | 8286 | 37 | 61 |
| 6151 | 7605 | 11 | 35 |
| 6152 | 7378 | 37 | 60 |
| 6152 | 8366 | 11 | 34 |
| 6153 | 6771 | 11 | 31 |
| 6154 | 7112 | 11 | 32 |
| 6155 | 7035 | 89 | 109 |
| 6155 | 7109 | 89 | 109 |
| 6156 | 7028 | 11 | 35 |
| 6156 | 7400 | 11 | 35 |
| 6156 | 8103 | 11 | 35 |
| 6157 | 7288 | 11 | 32 |
| 6157 | 8355 | 11 | 32 |
| 6158 | 8360 | 58 | 81 |
| 6159 | 8095 | 37 | 56 |
| 6160 | 7666 | 38 | 58 |
| 6161 | 7036 | 11 | 33 |
| 6162 | 8067 | 11 | 35 |
| 6163 | 7637 | 11 | 34 |
| 6164 | 6907 | 173 | 195 |
| 6164 | 7401 | 173 | 195 |
| 6164 | 8031 | 173 | 195 |
| 6165 | 6900 | 11 | 31 |
| 6166 | 7989 | 11 | 34 |
| 6167 | 7249 | 11 | 31 |
| 6168 | 7038 | 157 | 176 |
| 6169 | 7270 | 49 | 68 |
| 6170 | 7547 | 6 | 27 |
| 6171 | 7985 | 11 | 31 |
| 6172 | 7782 | 11 | 34 |
| 6173 | 7769 | 11 | 34 |
| 6174 | 7595 | 11 | 34 |
| 6175 | 7953 | 11 | 35 |
| 6176 | 8392 | 11 | 32 |
| 6177 | 7731 | 248 | 269 |
| 6177 | 8279 | 242 | 263 |
| 6178 | 7826 | 11 | 32 |
| 6179 | 6882 | 39 | 62 |
| 6179 | 7344 | 11 | 34 |
| 6179 | 7584 | 39 | 62 |
| 6179 | 7695 | 39 | 62 |
| 6179 | 8117 | 38 | 61 |
| 6180 | 7767 | 11 | 32 |
| 6180 | 7789 | 11 | 32 |
| 6180 | 7926 | 11 | 32 |
| 6181 | 7472 | 11 | 30 |
| 6182 | 8389 | 70 | 89 |
| 6183 | 7370 | 11 | 31 |
| 6183 | 7878 | 11 | 31 |
| 6184 | 6794 | 71 | 93 |
| 6185 | 6697 | 11 | 31 |
| 6185 | 7337 | 11 | 31 |
| 6185 | 8294 | 11 | 31 |
| 6186 | 7881 | 43 | 62 |
| 6187 | 7777 | 11 | 33 |
| 6188 | 6890 | 11 | 34 |
| 6189 | 7179 | 174 | 197 |
| 6190 | 6898 | 11 | 34 |
| 6191 | 7451 | 11 | 34 |
| 6192 | 7594 | 11 | 34 |
| 6193 | 7136 | 59 | 79 |
| 6193 | 8373 | 59 | 79 |
| 6193 | 8382 | 59 | 79 |
| 6194 | 8142 | 42 | 65 |
| 6195 | 6962 | 11 | 33 |
| 6195 | 6981 | 11 | 33 |
| 6195 | 7350 | 11 | 33 |
| 6195 | 7418 | 11 | 33 |
| 6195 | 7536 | 11 | 33 |
| 6195 | 7537 | 11 | 33 |
| 6195 | 7538 | 11 | 33 |
| 6195 | 8391 | 11 | 33 |
| 6196 | 7114 | 100 | 121 |
| 6197 | 6776 | 104 | 123 |
| 6197 | 6810 | 104 | 123 |
| 6198 | 7198 | 11 | 32 |
| 6198 | 7222 | 11 | 32 |
| 6198 | 7924 | 51 | 72 |

TABLE 6-continued

Maize and soybean miRNAs and miRNA precursors

| miRNA SEQ ID NO. | pre-miRNA SEQ ID NO. | Nucleotide position of miRNA in pre-miRNA | |
|---|---|---|---|
| | | from | to |
| 6199 | 6689 | 72 | 93 |
| 6199 | 7342 | 72 | 93 |
| 6199 | 7498 | 72 | 93 |
| 6200 | 7236 | 11 | 31 |
| 6201 | 8052 | 11 | 34 |
| 6202 | 7235 | 11 | 35 |
| 6202 | 8162 | 11 | 35 |
| 6202 | 8169 | 11 | 35 |
| 6203 | 7320 | 11 | 34 |
| 6204 | 6980 | 11 | 31 |
| 6205 | 7123 | 11 | 30 |
| 6206 | 7559 | 304 | 325 |
| 6207 | 6950 | 43 | 62 |
| 6207 | 6987 | 43 | 62 |
| 6207 | 7858 | 11 | 30 |
| 6208 | 7493 | 11 | 33 |
| 6209 | 8240 | 203 | 222 |
| 6210 | 7011 | 11 | 34 |
| 6211 | 7982 | 37 | 57 |
| 6212 | 6758 | 11 | 30 |
| 6212 | 8304 | 11 | 30 |
| 6213 | 6777 | 45 | 68 |
| 6214 | 7052 | 40 | 59 |
| 6215 | 7137 | 46 | 68 |
| 6215 | 7139 | 47 | 69 |
| 6216 | 7382 | 11 | 30 |
| 6217 | 6997 | 33 | 52 |
| 6218 | 7267 | 11 | 31 |
| 6218 | 7387 | 51 | 71 |
| 6218 | 7419 | 51 | 71 |
| 6218 | 7518 | 11 | 31 |
| 6218 | 7527 | 51 | 71 |
| 6218 | 7795 | 11 | 31 |
| 6218 | 7908 | 51 | 71 |
| 6218 | 7998 | 51 | 71 |
| 6218 | 8114 | 11 | 31 |
| 6218 | 8184 | 51 | 71 |
| 6218 | 8335 | 11 | 31 |
| 6219 | 8201 | 11 | 34 |
| 6220 | 7621 | 11 | 34 |
| 6221 | 7098 | 11 | 31 |
| 6222 | 7847 | 47 | 68 |
| 6223 | 7896 | 33 | 53 |
| 6224 | 8051 | 11 | 34 |
| 6225 | 8231 | 49 | 72 |
| 6226 | 8036 | 10 | 33 |
| 6227 | 7448 | 41 | 64 |
| 6228 | 7990 | 1 | 24 |
| 6229 | 7684 | 137 | 160 |
| 6230 | 6737 | 11 | 34 |
| 6230 | 7155 | 11 | 34 |
| 6231 | 7473 | 11 | 34 |
| 6232 | 7024 | 44 | 63 |
| 6232 | 8010 | 43 | 62 |
| 6232 | 8329 | 44 | 63 |
| 6233 | 6908 | 41 | 60 |
| 6234 | 8274 | 40 | 63 |
| 6235 | 8136 | 11 | 30 |
| 6236 | 6726 | 137 | 160 |
| 6237 | 8110 | 11 | 34 |
| 6238 | 7884 | 38 | 59 |
| 6239 | 7995 | 11 | 30 |
| 6240 | 8000 | 46 | 69 |
| 6241 | 7751 | 11 | 34 |
| 6242 | 6702 | 11 | 30 |
| 6242 | 8331 | 11 | 30 |
| 6242 | 8397 | 11 | 30 |
| 6243 | 7054 | 75 | 95 |
| 6243 | 7346 | 75 | 95 |
| 6244 | 7050 | 11 | 34 |
| 6245 | 6855 | 71 | 90 |
| 6245 | 8370 | 71 | 90 |
| 6246 | 7900 | 84 | 106 |
| 6247 | 6846 | 112 | 135 |
| 6248 | 7579 | 47 | 68 |
| 6248 | 7734 | 47 | 68 |
| 6249 | 7278 | 128 | 148 |
| 6250 | 7146 | 11 | 30 |
| 6251 | 7708 | 38 | 58 |
| 6252 | 7313 | 47 | 70 |
| 6253 | 6699 | 11 | 34 |
| 6254 | 7199 | 72 | 93 |
| 6255 | 6868 | 49 | 69 |
| 6255 | 7362 | 49 | 69 |
| 6255 | 7604 | 49 | 69 |
| 6256 | 7977 | 39 | 62 |
| 6257 | 8302 | 11 | 31 |
| 6258 | 8196 | 11 | 31 |
| 6259 | 7108 | 11 | 34 |
| 6260 | 8243 | 236 | 259 |
| 6261 | 7284 | 11 | 32 |
| 6261 | 7746 | 11 | 32 |
| 6262 | 7349 | 38 | 58 |
| 6262 | 7402 | 11 | 31 |
| 6263 | 7261 | 33 | 55 |
| 6263 | 7629 | 34 | 56 |
| 6263 | 8309 | 33 | 55 |
| 6264 | 7189 | 11 | 34 |
| 6265 | 6899 | 11 | 34 |
| 6266 | 6889 | 33 | 52 |
| 6267 | 6937 | 11 | 35 |
| 6268 | 7455 | 11 | 31 |
| 6269 | 6796 | 11 | 31 |
| 6269 | 7656 | 11 | 31 |
| 6270 | 6897 | 78 | 102 |
| 6271 | 7102 | 35 | 55 |
| 6271 | 8197 | 35 | 55 |
| 6272 | 6825 | 86 | 109 |
| 6272 | 7090 | 86 | 109 |
| 6273 | 7961 | 53 | 75 |
| 6274 | 8044 | 54 | 74 |
| 6275 | 7077 | 34 | 55 |
| 6276 | 7203 | 95 | 116 |
| 6277 | 7478 | 71 | 91 |
| 6278 | 7494 | 177 | 200 |
| 6278 | 7999 | 11 | 34 |
| 6279 | 7870 | 11 | 34 |
| 6280 | 7877 | 11 | 34 |
| 6281 | 7505 | 11 | 34 |
| 6281 | 7533 | 11 | 34 |
| 6281 | 7534 | 11 | 34 |
| 6282 | 7325 | 82 | 103 |
| 6283 | 7694 | 190 | 209 |
| 6284 | 6994 | 31 | 51 |
| 6284 | 8061 | 31 | 51 |
| 6285 | 6887 | 48 | 70 |
| 6286 | 7456 | 141 | 164 |
| 6287 | 7489 | 46 | 67 |
| 6288 | 7846 | 51 | 72 |
| 6289 | 7659 | 11 | 34 |
| 6290 | 7405 | 47 | 70 |
| 6290 | 7955 | 47 | 70 |
| 6290 | 7960 | 47 | 70 |
| 6291 | 7651 | 36 | 55 |
| 6291 | 7904 | 61 | 80 |
| 6292 | 8168 | 52 | 73 |
| 6293 | 7743 | 11 | 30 |
| 6294 | 7519 | 11 | 32 |
| 6295 | 7238 | 11 | 30 |
| 6295 | 7385 | 11 | 30 |
| 6295 | 7903 | 11 | 30 |
| 6296 | 7159 | 11 | 30 |
| 6297 | 7214 | 11 | 31 |
| 6298 | 8297 | 42 | 62 |
| 6299 | 7886 | 44 | 63 |
| 6300 | 6936 | 170 | 189 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 6301 | 8118 | 134 | 156 |
| 6302 | 8177 | 376 | 397 |
| 6303 | 7776 | 11 | 34 |
| 6304 | 7081 | 40 | 61 |
| 6305 | 7348 | 42 | 65 |
| 6306 | 7586 | 59 | 82 |
| 6307 | 6963 | 112 | 132 |
| 6308 | 6805 | 11 | 35 |
| 6308 | 7257 | 11 | 35 |
| 6309 | 7332 | 83 | 102 |
| 6310 | 7825 | 237 | 260 |
| 6311 | 7333 | 11 | 34 |
| 6311 | 7334 | 11 | 34 |
| 6312 | 6802 | 11 | 35 |
| 6312 | 6925 | 11 | 35 |
| 6312 | 7080 | 11 | 35 |
| 6312 | 7592 | 11 | 35 |
| 6312 | 7596 | 11 | 35 |
| 6312 | 7600 | 11 | 35 |
| 6312 | 7639 | 11 | 35 |
| 6312 | 7699 | 11 | 35 |
| 6312 | 7702 | 11 | 35 |
| 6312 | 7733 | 11 | 35 |
| 6312 | 7842 | 11 | 35 |
| 6312 | 7923 | 11 | 35 |
| 6312 | 8081 | 11 | 35 |
| 6312 | 8093 | 11 | 35 |
| 6312 | 8183 | 11 | 35 |
| 6313 | 6808 | 11 | 31 |
| 6313 | 6828 | 11 | 31 |
| 6314 | 7065 | 11 | 32 |
| 6314 | 7066 | 11 | 32 |
| 6314 | 7067 | 11 | 32 |
| 6314 | 8388 | 11 | 32 |
| 6315 | 7425 | 213 | 234 |
| 6316 | 7509 | 11 | 34 |
| 6317 | 7416 | 11 | 30 |
| 6318 | 7788 | 92 | 111 |
| 6319 | 6891 | 34 | 54 |
| 6319 | 7169 | 151 | 171 |
| 6320 | 6753 | 79 | 99 |
| 6321 | 7250 | 31 | 51 |
| 6322 | 6806 | 52 | 75 |
| 6323 | 8319 | 305 | 325 |
| 6324 | 7365 | 55 | 75 |
| 6325 | 7131 | 11 | 34 |
| 6326 | 7764 | 38 | 57 |
| 6327 | 6922 | 11 | 30 |
| 6328 | 8018 | 141 | 160 |
| 6329 | 7742 | 98 | 117 |
| 6330 | 7187 | 11 | 31 |
| 6331 | 6969 | 70 | 93 |
| 6332 | 7391 | 62 | 85 |
| 6333 | 8402 | 236 | 258 |
| 6334 | 7898 | 37 | 60 |
| 6335 | 7426 | 11 | 32 |
| 6336 | 7366 | 217 | 236 |
| 6337 | 6888 | 11 | 34 |
| 6338 | 7486 | 189 | 211 |
| 6339 | 6953 | 11 | 32 |
| 6339 | 7925 | 11 | 32 |
| 6340 | 8165 | 11 | 32 |
| 6341 | 6839 | 11 | 33 |
| 6342 | 7079 | 242 | 262 |
| 6343 | 7289 | 11 | 31 |
| 6343 | 7852 | 11 | 31 |
| 6344 | 7750 | 11 | 31 |
| 6345 | 7657 | 10 | 30 |
| 6345 | 8251 | 11 | 31 |
| 6346 | 7107 | 11 | 33 |
| 6347 | 7180 | 240 | 262 |
| 6347 | 8219 | 236 | 258 |
| 6348 | 7800 | 11 | 30 |
| 6349 | 8288 | 218 | 237 |
| 6350 | 6954 | 11 | 30 |
| 6351 | 6985 | 43 | 66 |
| 6352 | 7624 | 48 | 68 |
| 6353 | 7269 | 11 | 31 |
| 6354 | 7007 | 11 | 33 |
| 6355 | 6961 | 208 | 228 |
| 6355 | 8265 | 208 | 228 |
| 6356 | 6691 | 11 | 34 |
| 6357 | 7315 | 11 | 31 |
| 6358 | 6751 | 196 | 215 |
| 6359 | 6759 | 11 | 31 |
| 6360 | 8206 | 200 | 222 |
| 6360 | 8351 | 200 | 222 |
| 6361 | 7609 | 11 | 31 |
| 6362 | 7492 | 11 | 32 |
| 6363 | 8371 | 350 | 374 |
| 6364 | 6927 | 116 | 135 |
| 6365 | 7104 | 230 | 251 |
| 6366 | 7255 | 11 | 31 |
| 6367 | 7126 | 64 | 83 |
| 6368 | 7980 | 11 | 33 |
| 6369 | 7602 | 11 | 32 |
| 6370 | 7854 | 11 | 33 |
| 6371 | 8157 | 11 | 31 |
| 6372 | 7570 | 136 | 156 |
| 6373 | 7343 | 52 | 71 |
| 6374 | 8002 | 11 | 30 |
| 6374 | 8022 | 11 | 30 |
| 6375 | 6746 | 43 | 63 |
| 6375 | 7004 | 43 | 63 |
| 6375 | 7157 | 11 | 31 |
| 6375 | 7384 | 43 | 63 |
| 6375 | 7939 | 43 | 63 |
| 6375 | 8374 | 11 | 31 |
| 6376 | 7987 | 11 | 32 |
| 6377 | 7471 | 11 | 33 |
| 6377 | 7480 | 52 | 74 |
| 6377 | 7689 | 51 | 73 |
| 6378 | 7111 | 11 | 34 |
| 6379 | 7097 | 167 | 187 |
| 6379 | 7662 | 11 | 31 |
| 6380 | 7701 | 11 | 30 |
| 6381 | 7974 | 95 | 118 |
| 6382 | 7062 | 62 | 85 |
| 6383 | 8220 | 69 | 91 |
| 6384 | 7347 | 40 | 60 |
| 6384 | 8223 | 40 | 60 |
| 6385 | 7113 | 40 | 64 |
| 6385 | 7164 | 40 | 64 |
| 6385 | 7729 | 11 | 35 |
| 6386 | 6982 | 58 | 78 |
| 6387 | 7083 | 65 | 89 |
| 6387 | 7946 | 70 | 94 |
| 6387 | 8316 | 71 | 95 |
| 6388 | 7645 | 11 | 34 |
| 6389 | 6896 | 11 | 35 |
| 6390 | 7071 | 35 | 55 |
| 6390 | 7084 | 35 | 55 |
| 6391 | 6801 | 48 | 72 |
| 6392 | 7722 | 11 | 30 |
| 6393 | 7582 | 219 | 242 |
| 6394 | 7172 | 240 | 262 |
| 6395 | 8405 | 11 | 34 |
| 6396 | 7949 | 65 | 87 |
| 6397 | 8401 | 82 | 103 |
| 6398 | 8097 | 37 | 59 |
| 6399 | 6701 | 47 | 70 |
| 6400 | 7075 | 11 | 32 |
| 6401 | 7298 | 11 | 34 |
| 6402 | 8059 | 35 | 56 |
| 6403 | 7301 | 11 | 30 |
| 6403 | 8256 | 11 | 30 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 6404 | 7120 | 30 | 50 |
| 6405 | 7258 | 11 | 33 |
| 6406 | 7263 | 11 | 31 |
| 6407 | 8003 | 11 | 34 |
| 6408 | 6876 | 11 | 31 |
| 6409 | 6914 | 11 | 31 |
| 6409 | 7938 | 11 | 31 |
| 6410 | 6779 | 32 | 52 |
| 6410 | 7364 | 32 | 52 |
| 6411 | 7043 | 11 | 32 |
| 6411 | 7797 | 11 | 32 |
| 6412 | 6883 | 11 | 30 |
| 6413 | 6733 | 46 | 68 |
| 6414 | 7467 | 81 | 101 |
| 6415 | 7422 | 11 | 31 |
| 6415 | 7766 | 11 | 31 |
| 6416 | 7148 | 34 | 53 |
| 6417 | 7661 | 11 | 33 |
| 6418 | 6757 | 11 | 31 |
| 6418 | 7468 | 11 | 31 |
| 6419 | 6834 | 37 | 56 |
| 6420 | 6851 | 11 | 35 |
| 6420 | 6971 | 11 | 35 |
| 6420 | 7311 | 11 | 35 |
| 6420 | 7374 | 11 | 35 |
| 6420 | 7626 | 11 | 35 |
| 6420 | 7784 | 11 | 35 |
| 6420 | 7799 | 11 | 35 |
| 6420 | 8313 | 11 | 35 |
| 6420 | 8338 | 11 | 35 |
| 6421 | 7017 | 215 | 238 |
| 6422 | 7053 | 125 | 148 |
| 6422 | 7185 | 11 | 34 |
| 6423 | 8325 | 11 | 30 |
| 6424 | 7757 | 11 | 30 |
| 6425 | 7211 | 32 | 52 |
| 6426 | 7976 | 389 | 412 |
| 6427 | 8037 | 49 | 73 |
| 6428 | 7916 | 11 | 30 |
| 6429 | 8342 | 33 | 54 |
| 6430 | 7531 | 11 | 31 |
| 6431 | 7830 | 3 | 25 |
| 6432 | 7411 | 133 | 155 |
| 6433 | 6965 | 45 | 64 |
| 6433 | 7449 | 46 | 65 |
| 6433 | 7562 | 45 | 64 |
| 6433 | 8033 | 11 | 30 |
| 6434 | 7791 | 155 | 176 |
| 6435 | 7516 | 134 | 157 |
| 6436 | 7389 | 69 | 89 |
| 6437 | 8334 | 76 | 96 |
| 6438 | 7147 | 11 | 30 |
| 6438 | 7147 | 54 | 73 |
| 6438 | 8269 | 11 | 30 |
| 6439 | 7272 | 11 | 30 |
| 6439 | 8271 | 11 | 30 |
| 6440 | 8227 | 52 | 75 |
| 6441 | 7636 | 11 | 34 |
| 6442 | 7593 | 11 | 34 |
| 6442 | 7593 | 67 | 90 |
| 6442 | 8381 | 11 | 34 |
| 6442 | 8381 | 67 | 90 |
| 6443 | 7818 | 46 | 69 |
| 6443 | 8077 | 44 | 67 |
| 6444 | 7676 | 11 | 34 |
| 6444 | 7808 | 11 | 34 |
| 6445 | 7420 | 11 | 31 |
| 6446 | 6814 | 138 | 157 |
| 6447 | 6728 | 202 | 222 |
| 6447 | 7368 | 201 | 221 |
| 6448 | 7535 | 11 | 34 |
| 6449 | 6822 | 1 | 24 |
| 6449 | 7513 | 11 | 34 |
| 6450 | 8249 | 47 | 70 |
| 6451 | 7056 | 11 | 34 |
| 6452 | 7309 | 98 | 119 |
| 6453 | 7299 | 32 | 51 |
| 6453 | 7623 | 26 | 45 |
| 6454 | 8104 | 71 | 93 |
| 6455 | 7291 | 51 | 72 |
| 6455 | 7292 | 51 | 72 |
| 6456 | 7658 | 31 | 50 |
| 6457 | 7099 | 11 | 34 |
| 6457 | 8132 | 11 | 34 |
| 6457 | 8139 | 11 | 34 |
| 6458 | 8258 | 11 | 30 |
| 6459 | 6841 | 60 | 84 |
| 6460 | 6901 | 51 | 72 |
| 6461 | 8082 | 11 | 30 |
| 6462 | 7640 | 11 | 34 |
| 6463 | 7091 | 11 | 31 |
| 6464 | 8070 | 11 | 32 |
| 6465 | 7329 | 62 | 81 |
| 6465 | 7574 | 62 | 81 |
| 6465 | 7716 | 62 | 81 |
| 6465 | 7935 | 62 | 81 |
| 6465 | 8317 | 62 | 81 |
| 6465 | 8353 | 62 | 81 |
| 6465 | 8369 | 62 | 81 |
| 6466 | 7597 | 70 | 90 |
| 6467 | 7437 | 221 | 244 |
| 6467 | 7541 | 75 | 98 |
| 6468 | 6874 | 11 | 30 |
| 6468 | 6945 | 11 | 30 |
| 6468 | 7153 | 11 | 30 |
| 6469 | 7803 | 192 | 213 |
| 6470 | 7940 | 11 | 34 |
| 6470 | 7940 | 67 | 90 |
| 6471 | 6727 | 11 | 32 |
| 6471 | 6913 | 11 | 32 |
| 6472 | 7432 | 2 | 23 |
| 6473 | 7345 | 11 | 31 |
| 6474 | 7703 | 62 | 85 |
| 6475 | 7969 | 30 | 49 |
| 6476 | 7130 | 35 | 57 |
| 6477 | 7162 | 251 | 272 |
| 6478 | 7201 | 74 | 98 |
| 6478 | 7413 | 11 | 35 |
| 6478 | 7421 | 74 | 98 |
| 6478 | 7452 | 74 | 98 |
| 6478 | 7567 | 74 | 98 |
| 6478 | 7963 | 74 | 98 |
| 6479 | 7952 | 11 | 30 |
| 6480 | 7128 | 68 | 92 |
| 6481 | 7610 | 11 | 34 |
| 6482 | 8121 | 11 | 32 |
| 6483 | 7506 | 11 | 32 |
| 6483 | 7787 | 11 | 32 |
| 6483 | 7901 | 11 | 32 |
| 6484 | 8318 | 42 | 63 |
| 6484 | 8346 | 42 | 63 |
| 6485 | 7372 | 11 | 34 |
| 6486 | 7369 | 11 | 35 |
| 6487 | 7805 | 87 | 106 |
| 6488 | 6915 | 36 | 59 |
| 6489 | 7444 | 60 | 82 |
| 6490 | 6857 | 11 | 34 |
| 6490 | 7376 | 11 | 34 |
| 6490 | 8181 | 11 | 34 |
| 6491 | 6783 | 11 | 32 |
| 6491 | 7429 | 11 | 32 |
| 6491 | 7889 | 10 | 31 |
| 6491 | 8167 | 11 | 32 |
| 6492 | 7589 | 196 | 215 |
| 6493 | 7911 | 62 | 83 |
| 6494 | 7231 | 11 | 31 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 6495 | 7371 | 11 | 34 |
| 6496 | 6956 | 11 | 34 |
| 6496 | 8007 | 11 | 34 |
| 6497 | 8207 | 11 | 33 |
| 6498 | 7006 | 11 | 34 |
| 6499 | 7341 | 189 | 209 |
| 6500 | 7682 | 45 | 69 |
| 6501 | 7674 | 11 | 35 |
| 6501 | 7712 | 11 | 35 |
| 6502 | 7008 | 11 | 33 |
| 6503 | 7465 | 170 | 191 |
| 6504 | 7022 | 11 | 30 |
| 6505 | 6920 | 47 | 66 |
| 6505 | 8311 | 47 | 66 |
| 6506 | 7304 | 60 | 79 |
| 6507 | 6785 | 92 | 111 |
| 6507 | 8105 | 29 | 48 |
| 6507 | 8134 | 28 | 47 |
| 6508 | 7542 | 71 | 94 |
| 6509 | 6714 | 41 | 64 |
| 6509 | 7894 | 41 | 64 |
| 6509 | 7959 | 42 | 65 |
| 6510 | 7761 | 186 | 209 |
| 6511 | 7603 | 250 | 273 |
| 6512 | 7254 | 11 | 30 |
| 6513 | 7497 | 240 | 262 |
| 6514 | 7445 | 41 | 60 |
| 6515 | 7200 | 169 | 189 |
| 6515 | 7280 | 169 | 189 |
| 6515 | 7649 | 169 | 189 |
| 6516 | 6973 | 11 | 32 |
| 6516 | 7327 | 11 | 32 |
| 6516 | 7957 | 11 | 32 |
| 6517 | 8014 | 41 | 63 |
| 6518 | 7942 | 81 | 104 |
| 6519 | 7186 | 11 | 30 |
| 6520 | 7464 | 61 | 84 |
| 6521 | 7687 | 11 | 32 |
| 6522 | 6988 | 11 | 30 |
| 6523 | 6843 | 11 | 30 |
| 6524 | 7013 | 11 | 32 |
| 6525 | 6844 | 11 | 32 |
| 6525 | 8188 | 11 | 32 |
| 6525 | 8320 | 11 | 32 |
| 6526 | 7328 | 143 | 164 |
| 6527 | 6799 | 11 | 32 |
| 6528 | 7271 | 11 | 32 |
| 6529 | 7242 | 11 | 32 |
| 6530 | 8138 | 11 | 34 |
| 6531 | 6742 | 11 | 30 |
| 6532 | 7399 | 11 | 31 |
| 6533 | 7607 | 176 | 195 |
| 6534 | 7171 | 3 | 22 |
| 6535 | 7029 | 41 | 62 |
| 6535 | 7176 | 41 | 62 |
| 6535 | 7195 | 41 | 62 |
| 6535 | 7196 | 11 | 32 |
| 6535 | 8101 | 108 | 129 |
| 6536 | 7424 | 11 | 31 |
| 6537 | 6811 | 11 | 34 |
| 6538 | 7917 | 11 | 32 |
| 6539 | 7039 | 11 | 32 |
| 6539 | 7244 | 11 | 32 |
| 6539 | 7647 | 11 | 32 |
| 6540 | 8324 | 174 | 197 |
| 6541 | 6933 | 11 | 34 |
| 6542 | 6704 | 11 | 33 |
| 6542 | 6773 | 11 | 33 |
| 6542 | 7160 | 11 | 33 |
| 6542 | 7970 | 11 | 33 |
| 6543 | 6946 | 11 | 31 |
| 6544 | 7229 | 11 | 30 |
| 6544 | 8361 | 11 | 30 |
| 6545 | 7151 | 11 | 32 |
| 6546 | 7260 | 3 | 24 |
| 6547 | 7561 | 11 | 32 |
| 6548 | 8190 | 11 | 31 |
| 6548 | 8218 | 11 | 31 |
| 6549 | 8072 | 11 | 34 |
| 6550 | 7563 | 34 | 57 |
| 6551 | 8226 | 11 | 31 |
| 6552 | 6747 | 11 | 34 |
| 6553 | 7827 | 11 | 30 |
| 6554 | 6871 | 86 | 107 |
| 6554 | 7783 | 86 | 107 |
| 6555 | 7598 | 11 | 34 |
| 6556 | 7941 | 9 | 29 |
| 6556 | 8060 | 9 | 29 |
| 6557 | 7479 | 8 | 30 |
| 6558 | 7861 | 11 | 34 |
| 6559 | 7876 | 120 | 143 |
| 6560 | 7282 | 90 | 112 |
| 6560 | 7283 | 185 | 207 |
| 6561 | 6979 | 11 | 34 |
| 6561 | 7219 | 11 | 34 |
| 6562 | 7215 | 35 | 58 |
| 6563 | 6695 | 11 | 34 |
| 6563 | 6743 | 57 | 80 |
| 6563 | 6835 | 11 | 34 |
| 6563 | 7070 | 57 | 80 |
| 6563 | 7453 | 11 | 34 |
| 6563 | 7724 | 11 | 34 |
| 6563 | 7740 | 11 | 34 |
| 6563 | 7741 | 11 | 34 |
| 6563 | 7824 | 11 | 34 |
| 6563 | 8086 | 57 | 80 |
| 6563 | 8140 | 57 | 80 |
| 6563 | 8321 | 11 | 34 |
| 6564 | 6706 | 11 | 30 |
| 6565 | 6755 | 101 | 122 |
| 6565 | 6797 | 100 | 121 |
| 6565 | 7725 | 101 | 122 |
| 6565 | 8191 | 101 | 122 |
| 6566 | 7002 | 11 | 35 |
| 6567 | 8280 | 11 | 34 |
| 6568 | 7212 | 61 | 80 |
| 6569 | 7023 | 11 | 31 |
| 6569 | 7693 | 11 | 31 |
| 6569 | 7994 | 11 | 31 |
| 6569 | 8160 | 11 | 31 |
| 6569 | 8161 | 11 | 31 |
| 6570 | 8323 | 11 | 32 |
| 6571 | 8322 | 84 | 107 |
| 6572 | 7307 | 11 | 34 |
| 6573 | 7796 | 11 | 34 |
| 6574 | 7683 | 11 | 34 |
| 6575 | 6803 | 195 | 215 |
| 6576 | 7967 | 11 | 33 |
| 6577 | 7557 | 55 | 78 |
| 6578 | 7403 | 2 | 23 |
| 6579 | 6996 | 11 | 34 |
| 6579 | 7415 | 46 | 69 |
| 6579 | 7714 | 11 | 34 |
| 6580 | 8238 | 11 | 35 |
| 6581 | 6700 | 11 | 33 |
| 6582 | 6696 | 35 | 55 |
| 6583 | 7103 | 11 | 34 |
| 6584 | 7161 | 34 | 54 |
| 6585 | 8242 | 11 | 33 |
| 6586 | 7433 | 100 | 123 |
| 6587 | 7386 | 11 | 30 |
| 6588 | 8332 | 95 | 118 |
| 6589 | 8224 | 11 | 31 |
| 6590 | 7019 | 11 | 32 |
| 6590 | 8277 | 11 | 32 |
| 6591 | 7094 | 11 | 31 |

TABLE 6-continued

Maize and soybean miRNAs and miRNA precursors

| miRNA SEQ ID NO. | pre-miRNA SEQ ID NO. | Nucleotide position of miRNA in pre-miRNA | |
|---|---|---|---|
| | | from | to |
| 6592 | 7785 | 11 | 33 |
| 6593 | 7792 | 211 | 234 |
| 6594 | 7951 | 11 | 30 |
| 6595 | 7560 | 39 | 59 |
| 6596 | 6903 | 219 | 240 |
| 6597 | 6939 | 11 | 30 |
| 6598 | 6800 | 11 | 34 |
| 6599 | 8379 | 41 | 65 |
| 6600 | 6999 | 11 | 30 |
| 6600 | 7690 | 11 | 30 |
| 6601 | 6717 | 11 | 34 |
| 6601 | 7679 | 11 | 34 |
| 6602 | 7409 | 224 | 244 |
| 6603 | 8212 | 34 | 53 |
| 6604 | 7615 | 11 | 32 |
| 6604 | 7616 | 11 | 32 |
| 6604 | 7671 | 11 | 32 |
| 6604 | 7696 | 11 | 32 |
| 6605 | 6831 | 91 | 115 |
| 6605 | 8088 | 91 | 115 |
| 6606 | 8071 | 37 | 60 |
| 6607 | 6964 | 11 | 31 |
| 6608 | 8398 | 143 | 162 |
| 6609 | 8089 | 45 | 65 |
| 6610 | 8020 | 11 | 34 |
| 6611 | 8299 | 11 | 31 |
| 6612 | 6692 | 130 | 153 |
| 6612 | 6872 | 130 | 153 |
| 6613 | 6928 | 41 | 64 |
| 6614 | 7145 | 11 | 35 |
| 6615 | 7758 | 71 | 90 |
| 6616 | 7711 | 172 | 195 |
| 6617 | 8073 | 79 | 102 |
| 6618 | 6711 | 104 | 125 |
| 6619 | 6782 | 42 | 61 |
| 6620 | 7251 | 41 | 61 |
| 6621 | 7770 | 11 | 30 |
| 6622 | 7943 | 61 | 85 |
| 6623 | 7837 | 33 | 52 |
| 6624 | 6761 | 11 | 31 |
| 6625 | 8262 | 11 | 32 |
| 6626 | 7122 | 52 | 75 |
| 6627 | 6729 | 11 | 32 |
| 6627 | 7178 | 11 | 32 |
| 6628 | 7548 | 38 | 58 |
| 6629 | 7739 | 11 | 32 |
| 6629 | 8252 | 11 | 32 |
| 6630 | 8261 | 11 | 32 |
| 6630 | 8295 | 204 | 225 |
| 6631 | 7578 | 57 | 78 |
| 6632 | 7047 | 41 | 60 |
| 6632 | 7234 | 41 | 60 |
| 6632 | 7522 | 41 | 60 |
| 6633 | 7221 | 11 | 31 |
| 6634 | 7482 | 11 | 32 |
| 6634 | 8068 | 11 | 32 |
| 6635 | 8005 | 11 | 33 |
| 6636 | 8137 | 50 | 73 |
| 6637 | 6842 | 11 | 31 |
| 6638 | 6813 | 31 | 51 |
| 6638 | 7286 | 31 | 51 |
| 6638 | 8006 | 31 | 51 |
| 6639 | 6745 | 11 | 31 |
| 6639 | 7241 | 11 | 31 |
| 6639 | 7454 | 4 | 24 |
| 6640 | 7338 | 11 | 34 |
| 6641 | 7811 | 166 | 186 |
| 6642 | 8283 | 82 | 103 |
| 6643 | 6812 | 11 | 34 |
| 6644 | 8102 | 11 | 31 |
| 6645 | 6775 | 11 | 31 |
| 6646 | 7044 | 11 | 30 |
| 6647 | 6838 | 165 | 185 |
| 6648 | 6684 | 54 | 74 |
| 6649 | 7048 | 196 | 219 |
| 6650 | 7794 | 78 | 99 |
| 6651 | 8216 | 86 | 106 |
| 6652 | 8009 | 226 | 246 |
| 6653 | 6740 | 11 | 31 |
| 6653 | 7149 | 11 | 31 |
| 6653 | 8126 | 11 | 31 |
| 6653 | 8395 | 11 | 31 |
| 6654 | 7281 | 7 | 30 |
| 6655 | 7096 | 11 | 31 |
| 6655 | 7993 | 11 | 31 |
| 6656 | 7339 | 187 | 210 |
| 6657 | 6788 | 11 | 31 |
| 6657 | 6926 | 106 | 126 |
| 6657 | 7856 | 45 | 65 |
| 6657 | 8055 | 94 | 114 |
| 6658 | 8380 | 43 | 66 |
| 6659 | 6735 | 207 | 227 |
| 6659 | 7276 | 125 | 145 |
| 6659 | 7553 | 11 | 31 |
| 6660 | 6712 | 34 | 57 |
| 6661 | 7523 | 11 | 35 |
| 6662 | 8106 | 44 | 67 |
| 6663 | 6688 | 115 | 136 |
| 6664 | 7929 | 6 | 29 |
| 6665 | 6744 | 11 | 34 |
| 6666 | 8232 | 208 | 228 |
| 6667 | 8028 | 48 | 70 |
| 6668 | 7032 | 174 | 195 |
| 6669 | 8400 | 11 | 34 |
| 6670 | 8069 | 39 | 62 |
| 6671 | 7540 | 11 | 32 |
| 6672 | 7058 | 11 | 34 |
| 6673 | 8015 | 73 | 96 |
| 6674 | 6917 | 11 | 34 |
| 6675 | 6715 | 61 | 81 |
| 6675 | 6960 | 61 | 81 |
| 6675 | 7228 | 61 | 81 |
| 6676 | 6966 | 11 | 34 |
| 6677 | 7863 | 84 | 107 |
| 6678 | 7404 | 98 | 121 |
| 6678 | 7973 | 11 | 34 |
| 6678 | 8173 | 11 | 34 |
| 6679 | 7174 | 11 | 32 |
| 6680 | 8300 | 11 | 31 |
| 6681 | 7831 | 41 | 64 |
| 6682 | 8234 | 240 | 263 |
| 6683 | 8113 | 11 | 32 |
| 6683 | 8372 | 11 | 32 |
| 8409 | 8604 | 11 | 31 |
| 8409 | 8626 | 11 | 31 |
| 8410 | 8649 | 11 | 31 |
| 8411 | 8660 | 104 | 123 |
| 8412 | 8674 | 11 | 30 |
| 8413 | 8655 | 11 | 31 |
| 8414 | 8671 | 129 | 149 |
| 8415 | 8594 | 70 | 90 |
| 8415 | 8740 | 70 | 90 |
| 8416 | 8713 | 11 | 31 |
| 8417 | 8648 | 129 | 149 |
| 8418 | 8562 | 11 | 30 |
| 8418 | 8588 | 11 | 30 |
| 8418 | 8592 | 70 | 89 |
| 8419 | 8579 | 11 | 31 |
| 8420 | 8571 | 70 | 90 |
| 8420 | 8634 | 75 | 95 |
| 8421 | 8584 | 11 | 31 |
| 8422 | 8572 | 99 | 118 |
| 8422 | 8590 | 76 | 95 |
| 8423 | 8612 | 11 | 30 |
| 8424 | 8619 | 30 | 50 |
| 8425 | 8717 | 11 | 32 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 8426 | 8639 | 11 | 31 |
| 8427 | 8573 | 146 | 166 |
| 8428 | 8684 | 376 | 396 |
| 8429 | 8650 | 158 | 177 |
| 8430 | 8568 | 11 | 32 |
| 8430 | 8576 | 11 | 32 |
| 8430 | 8664 | 11 | 32 |
| 8431 | 8600 | 11 | 33 |
| 8432 | 8718 | 699 | 719 |
| 8433 | 8723 | 11 | 31 |
| 8434 | 8561 | 11 | 33 |
| 8435 | 8729 | 62 | 84 |
| 8436 | 8635 | 11 | 34 |
| 8437 | 8678 | 36 | 57 |
| 8438 | 8694 | 45 | 68 |
| 8439 | 8589 | 11 | 31 |
| 8440 | 8631 | 80 | 100 |
| 8441 | 8685 | 11 | 31 |
| 8442 | 8616 | 67 | 87 |
| 8443 | 8574 | 11 | 31 |
| 8444 | 8581 | 11 | 32 |
| 8445 | 8712 | 57 | 78 |
| 8446 | 8659 | 61 | 81 |
| 8447 | 8567 | 11 | 31 |
| 8448 | 8632 | 75 | 96 |
| 8449 | 8643 | 53 | 73 |
| 8450 | 8677 | 176 | 196 |
| 8451 | 8690 | 11 | 31 |
| 8452 | 8687 | 11 | 33 |
| 8453 | 8585 | 11 | 34 |
| 8454 | 8599 | 11 | 31 |
| 8455 | 8665 | 11 | 30 |
| 8456 | 8647 | 208 | 228 |
| 8457 | 8668 | 184 | 204 |
| 8458 | 8722 | 64 | 84 |
| 8459 | 8666 | 11 | 32 |
| 8460 | 8610 | 11 | 33 |
| 8461 | 8570 | 217 | 240 |
| 8462 | 8636 | 11 | 30 |
| 8463 | 8692 | 164 | 184 |
| 8464 | 8719 | 242 | 261 |
| 8465 | 8691 | 58 | 78 |
| 8466 | 8607 | 11 | 30 |
| 8466 | 8622 | 11 | 30 |
| 8467 | 8680 | 11 | 31 |
| 8468 | 8653 | 11 | 31 |
| 8469 | 8708 | 167 | 187 |
| 8470 | 8706 | 11 | 35 |
| 8471 | 8583 | 115 | 135 |
| 8472 | 8564 | 99 | 118 |
| 8472 | 8566 | 101 | 120 |
| 8472 | 8577 | 101 | 120 |
| 8472 | 8645 | 94 | 113 |
| 8472 | 8658 | 101 | 120 |
| 8472 | 8661 | 94 | 113 |
| 8473 | 8595 | 11 | 35 |
| 8474 | 8725 | 11 | 31 |
| 8475 | 8670 | 96 | 119 |
| 8476 | 8596 | 11 | 30 |
| 8477 | 8615 | 638 | 658 |
| 8478 | 8704 | 11 | 34 |
| 8479 | 8625 | 57 | 81 |
| 8480 | 8731 | 84 | 104 |
| 8481 | 8608 | 11 | 30 |
| 8482 | 8733 | 11 | 34 |
| 8483 | 8672 | 227 | 250 |
| 8484 | 8624 | 11 | 33 |
| 8485 | 8703 | 117 | 140 |
| 8486 | 8667 | 11 | 30 |
| 8487 | 8621 | 40 | 59 |
| 8488 | 8580 | 11 | 34 |
| 8489 | 8618 | 11 | 32 |
| 8490 | 8644 | 53 | 74 |
| 8491 | 8720 | 11 | 31 |
| 8492 | 8628 | 46 | 69 |
| 8493 | 8686 | 11 | 32 |
| 8494 | 8697 | 49 | 68 |
| 8495 | 8732 | 55 | 74 |
| 8496 | 8614 | 122 | 144 |
| 8497 | 8591 | 53 | 73 |
| 8498 | 8652 | 11 | 32 |
| 8499 | 8693 | 60 | 80 |
| 8500 | 8651 | 8 | 27 |
| 8501 | 8663 | 11 | 31 |
| 8502 | 8586 | 11 | 31 |
| 8503 | 8739 | 11 | 30 |
| 8504 | 8605 | 187 | 210 |
| 8504 | 8737 | 185 | 208 |
| 8505 | 8657 | 77 | 99 |
| 8506 | 8711 | 11 | 31 |
| 8507 | 8702 | 11 | 30 |
| 8508 | 8727 | 11 | 31 |
| 8509 | 8617 | 130 | 149 |
| 8509 | 8640 | 231 | 250 |
| 8510 | 8709 | 149 | 168 |
| 8511 | 8565 | 60 | 80 |
| 8512 | 8593 | 79 | 99 |
| 8512 | 8721 | 79 | 99 |
| 8512 | 8728 | 79 | 99 |
| 8513 | 8679 | 152 | 172 |
| 8514 | 8642 | 11 | 30 |
| 8515 | 8601 | 118 | 138 |
| 8516 | 8736 | 63 | 82 |
| 8517 | 8633 | 11 | 31 |
| 8518 | 8701 | 11 | 30 |
| 8519 | 8700 | 42 | 62 |
| 8520 | 8623 | 11 | 30 |
| 8521 | 8630 | 11 | 30 |
| 8522 | 8682 | 176 | 199 |
| 8523 | 8646 | 11 | 32 |
| 8524 | 8602 | 11 | 31 |
| 8525 | 8724 | 11 | 30 |
| 8526 | 8716 | 115 | 134 |
| 8527 | 8669 | 39 | 60 |
| 8528 | 8688 | 11 | 30 |
| 8529 | 8627 | 11 | 31 |
| 8530 | 8689 | 93 | 117 |
| 8530 | 8734 | 92 | 116 |
| 8531 | 8673 | 11 | 31 |
| 8532 | 8705 | 151 | 172 |
| 8533 | 8698 | 11 | 31 |
| 8534 | 8629 | 11 | 32 |
| 8535 | 8613 | 376 | 395 |
| 8536 | 8609 | 11 | 31 |
| 8537 | 8741 | 67 | 86 |
| 8538 | 8578 | 11 | 31 |
| 8538 | 8654 | 11 | 31 |
| 8539 | 8597 | 126 | 146 |
| 8540 | 8598 | 155 | 174 |
| 8541 | 8582 | 11 | 32 |
| 8542 | 8587 | 61 | 81 |
| 8543 | 8707 | 166 | 186 |
| 8544 | 8637 | 64 | 84 |
| 8544 | 8638 | 64 | 84 |
| 8544 | 8699 | 64 | 84 |
| 8545 | 8641 | 73 | 93 |
| 8546 | 8726 | 64 | 85 |
| 8547 | 8715 | 11 | 31 |
| 8548 | 8575 | 11 | 31 |
| 8549 | 8620 | 11 | 32 |
| 8550 | 8603 | 11 | 31 |
| 8551 | 8735 | 158 | 178 |
| 8552 | 8681 | 75 | 95 |
| 8553 | 8676 | 11 | 31 |
| 8553 | 8730 | 11 | 31 |
| 8554 | 8683 | 11 | 31 |

TABLE 6-continued

Maize and soybean miRNAs and miRNA precursors

| miRNA SEQ ID NO. | pre-miRNA SEQ ID NO. | Nucleotide position of miRNA in pre-miRNA from | to |
|---|---|---|---|
| 8555 | 8675 | 100 | 120 |
| 8556 | 8611 | 76 | 96 |
| 8556 | 8662 | 76 | 96 |
| 8556 | 8695 | 76 | 96 |
| 8556 | 8710 | 76 | 96 |
| 8557 | 8656 | 355 | 375 |
| 8558 | 8696 | 11 | 32 |
| 8558 | 8714 | 11 | 32 |
| 8559 | 8563 | 11 | 30 |
| 8559 | 8606 | 11 | 30 |
| 8559 | 8738 | 11 | 30 |
| 8560 | 8569 | 11 | 32 |

MicroRNAs and their precursors and promoters, especially those having a differential expression pattern between water-sufficient and water-insufficient (drought or water stress) conditions, are useful in engineering desirable traits (e.g., increased yield, improved germination) in crops that can experience water stress. Similar utility is found in other miR-NAs (and their precursors or promoters) having expression patterns specific to other abiotic or biotic stress conditions, e.g., miRNAs having a differential expression pattern between nutrient-sufficient and nutrient-insufficient conditions, or between thermally stressed and thermally non-stressed conditions. Suitable methods include the introduction of an exogenous miRNA recognition site into a sequence, deletion or modification of an endogenous miRNA recognition site from a sequence, engineering of a native miRNA or miRNA precursor sequence in order to recognize a sequence other than the endogenous target sequence, and use of a miRNA promoter to provide a particular expression pattern.

Example 6

This example describes identification of a crop plant miRNA (miRMON18) having a specific expression pattern characterized by strong expression under nitrogen-sufficient conditions and suppression under nitrogen-deficient conditions, or strong expression under phosphate-sufficient conditions and suppression under phosphate-deficient conditions Small RNAs were cloned and putative miRNAs identified from a variety of tissues and developmental stages from rice (*Oryza sativa* cv. Nipponbare), corn (maize, *Zea mays* var. LH244), and soybean (*Glycine max* var. A3525), following techniques described above in Example 1 and 5. Small RNA abundances were normalized between libraries and calculated as transcripts per quarter million sequences (tpq). A putative mature miRNA (small RNA number 370903, assigned the trivial name "miRMON18") with the sequence UUAGAUGACCAUCAGCAAACA was identified in rice (SEQ ID NO. 393), maize (SEQ ID NO. 3227), and soybean (SEQ ID NO. 8742) small RNA libraries. This sequence did not match known miRNAs in miRBase.

A miRMON18 precursor sequence was identified from the rice genome as CCAUGAACCUGUUUUGUUGCUGGU-CAUCUAGCUACCCGUGCAUGCCUGGAGAUUGG AGAAUAAUUGACGAUGCAGCAGUCGGCU-UAUUGGCUCUUGGGCACGCGUGG UUAGAUGACCAUCAGCAAACAAGUUCGUGAG, (SEQ ID NO. 1763, FIG. 7B). Another putative miRMON18 precursor sequence was identified from available maize genomic data as CUCCGAACCUGUUUUGUUGGUGGU-CAUUUAACCAUGCAUGCUUCGAUCGAUGGAUU GGUGCAUGCAUGGAUUAUUGCAUAGU-GUGAUGCAUGUGGCGCAUCAGUGCAUGG UUAGAUGACCAUCAGCAAACAUGUUCUUGAG (SEQ ID NO. 3936, FIG. 7A). The position of the mature miRMON18 is depicted above in underlined text in these precursor sequences (SEQ ID NO. 1763 and SEQ ID NO. 3936). Each miRMON18 precursor was predicted to form a fold-back structure (FIGS. 7A and 7B), with the mature miRNA (miRMON18) located in the 3' arm of the fold-back structure, with the predicted miRNA* ("miR-MON18*") located in the 5' arm; this was consistent with the much greater abundance of the mature miRMON18 relative to that of miRMON18* observed in the single corn locus MRT4577_378723C.3. A fold-back structure having the sequence UGCAACCCUUGAAU-GUGUUUGUUGAUUGAUAUCUACACAUGUUGAU-CAUCCUUGUG UUGAUCGAUUGGUUUAGAUGACC-AUCAACAAACUCUUUCGUGGUUUUGCA (SEQ ID NO. 8743, FIG. 7C) was identified in *Arabidopsis thaliana* as the precursor to a related mature miRNA with the sequence UUAGAUGACCAUCAACAAACU (miR827, SEQ ID NO. 8744). The mature miR827 was observed only at low abundance in *Arabidopsis thaliana*. Alignment of the two mature miRNAs shows that miR827 differs from miRMON18 by two nucleotides (FIG. 7D). This two nucleotide difference between miRMON18 and miR827 appears to be conserved between monocots and dicots, with miRMON18 identified in maize (*Zea mays*), rice (*Oryza sativa*), and sugar cane (*Saccharum officinarum*, data not shown) and miR827 identified in dicots (*Arabidopsis thaliana*).

Northern blots verified expression of the miRMON18 21-mer in at least rice (grain and seedling) and maize (kernel, leaf, and root) tissue samples from plants grown under normal (non-stressed) conditions, as depicted in FIG. 8A. MicroRNA precursors originate as polyadenylated transcripts generated by RNA polymerase II and standard transcription profiling of the maize miRMON18 precursor (SEQ ID NO. 3936, corresponding to probeset A1ZM068928_at) further confirmed elevated expression in maize endosperm, callus, and seedling (FIG. 8B), with expression in other tissues in this sample falling below the detection cut-off threshold of 500 units.

Expression of the maize miRMON18 precursor (SEQ ID NO. 3936) was analyzed in maize tissues from plants grown under water-deficient (drought) (FIG. 9A), cold (FIG. 9B), and nitrogen-deficient conditions (FIG. 9C). Expression of the miRMON18 precursor was relatively unaffected by water conditions in root, shoot, ear, kernel, and tassel, with expression in leaf and silk increased under water-deficient conditions relative to water-sufficient conditions (FIG. 9A); expression was also relatively unaffected by temperature (FIG. 9B). However, miRMON18 expression was highly responsive to nitrogen conditions, with about 2-fold suppression observed with nitrogen limitation (2 millimolar ammonium nitrate), relative to expression observed with sufficient nitrogen (20 millimolar ammonium nitrate) (FIG. 9C). This nitrogen-responsive expression pattern was verified by phosphor image quantification of Northern blots of small RNA samples, which showed an average 9.6-fold suppression of the mature miRMON18 21-mer over 3 time points (FIG. 1A). Thus, miRMON18 showed overall enhanced expression in maize endosperm and kernel, and strong suppression in leaves induced by nitrogen deficiency.

In another experiment, maize was grown in a hydroponic system under sufficient phosphate until the V3 stage, then phosphate deprived for up to 3 days. Leaf tissue samples were taken at 1 and 3 days after phosphate deprivation had begun. At 3 days, plants were returned to phosphate sufficiency and samples taken at 30 minutes and 6 hours after recovery. Control samples at each time point were taken from plants grown continually under phosphate sufficiency. FIG. 10B depicts the results of northern blots analyzed with a miRMON18 probe and demonstrates that, in this experiment, the maize miRMON18 mature miRNA exhibited in leaf tissue strong expression under phosphate-sufficient conditions and suppression under phosphate-deficient conditions.

Example 7

This example describes identification of genes having miRNA recognition sites (miRMON18 recognition sites) natively regulated by a crop plant miRNA (miRMON18) having an expression pattern characterized by strong expression under nitrogen-sufficient conditions and suppression under nitrogen-deficient conditions, or strong expression under phosphate-sufficient conditions and suppression under phosphate-deficient conditions.

Putative targets for the mature miRMON18 (UUAGAUGACCAUCAGCAAACA, SEQ ID NO. 393, SEQ ID NO. 3227, or SEQ ID NO. 8742) were identified and included a clade of genes in the SPX ("SYG1/Pho81/XPR1") domain family. The SPX domain has been assigned the protein family/domain identifier Pfam PF03105, and is a hydrophobic domain found in the N-terminus of several proteins, typically including a stretch of about 180 residues with three smaller sub-domains of 35-47 amino acids; see, e.g., the SPX entry for the Pfam database currently curated at the Janelia Farms Research Campus of the Howard Hughes Medical Institute, publicly available at pfam.janelia.org/family?acc=PF03105.

The majority of proteins in the SPX domain family include other conserved domains in their *C-terminus*. For example, several proteins in the SPX domain family also include in their *C-terminus* an EXS ("ERD1, XPR1, and SYG1") domain, Pfam PF03124, which is possibly involved in protein sorting; see, e.g., pfam.janelia.org/family?acc=PF03124. Other SPX proteins include a conserved VTC (vacuolar transporter chaperone 2) domain, Pfam PF09359; see, e.g., pfam.janelia.org/family?acc=PF09359. Several SPX proteins include a conserved MFS_1 or MFS ("major facilitator superfamily") domain, Pfam PF07690, which is involved in transporting small solutes such as small sugars and inorganic salts in response to chemiosmotic ion gradients; see pfam.janelia.org/family?acc=PF07690. The SPX domain is likely to be a transcription factor, and may function as a dimerization domain.

SPX proteins include those encoded by the PHO genes, which are involved in the loading of inorganic phosphate into the xylem of roots; see, e.g., Wang et al. (2004) *Plant Physiol.*, 135:400-411, who have described identification of several PHO1 homologues, conservation of the SPX domain within these proteins, and the PHO1 promoter's predominant expression in the vascular tissues of roots, leaves, stems, or flowers as well as in some nonvascular tissues. Proteins in the SPX domain family are possibly involved in G-protein associated signal transduction (and thus are possibly sensors of inorganic phosphate); see Ticconi and Abel (2004) *Trends Plant Sci.*, 9:548-555. The PHO1 genes include both the SPX domain and an EXS domain. Members of the PHO clade also include a RING domain (At1g02860 and At2g38920), or an MFS domain (At4g22990, At4g11810, and At1g63010); see Wang et al. (2004) *Plant Physiol.*, 135:400-411, especially FIG. 3 and FIG. 6*d*.

Recently, a gene named NLA was reported to be required for adaptation to low nitrogen availability in *Arabidopsis thaliana*; see Peng et al. (2007) *Plant Cell*, 50:320-337. NLA ("AtNLA", locus At1g02860), assigned UniProtKB/Swiss-Prot accession number Q2V4F9, has the sequence of MRT3702__101115C, SEQ ID NO. 8745; annotation of the NLA protein is publicly available at beta.uniprot.org/uniprot/Q2V4F9 and at pfam.janelia.org/protein?id=Q94C80_ARATH. The *Arabidopsis* NLA gene having the sequence of SEQ ID NO. 8745 contains an SPX domain, an MFS_1 domain, and a RING domain, and includes a miR827 recognition site (target) sequence TGTTTGTTGATGGT-CATCTAA (SEQ ID NO. 8746) located at nucleotide positions 135 through 155, which was validated as a target for the *Arabidopsis* miR827. The NLA encodes a C3HC4-type RING-finger ubiquitin ligase (AT1G02860.1, SEQ ID NO. 8747); mutating this gene disrupts the adaptability of *Arabidopsis* to nitrogen limitation.

Ten additional clones of the AtNLA gene were sequenced. Clones 1, 4, and 5 contained a partial AtNLA sequence (SEQ ID NO. 8748). Clone 2 contained an AtNLA sequence lacking the SPX domain (SEQ ID NO. 8749). Clone 3 contained an AtNLA sequence lacking the RING domain (SEQ ID NO. 8750). Clone 6 contained a genomic AtNLA fragment (SEQ ID NO. 8751) with a disrupted miR827 recognition site (target sequence) located at nucleotide positions 2142-2162. Clone 7 contained another AtNLA sequence (At1g63010, SEQ ID NO. 8752). Clone 8 contained another genomic AtNLA fragment (At1g63010, SEQ ID NO. 8753) with a disrupted miR827 recognition site (target sequence) located at nucleotide positions 2142-2162. Clone 9 contained another AtNLA sequence (At1g63010, SEQ ID NO. 8754) lacking the SPX domain. Clone 10 contained an AtNLA sequence (At1g63010, SEQ ID NO. 8755) lacking the MFS domain.

A number of "virtual" cDNAs were assembled from maize genomic and cDNA sequences, describing independent genes targeted by miRMON18. The first of these novel miRMON18 targets ("SPX_MFS__117961287", derived from BAC at GI:117961287) had the sequence of SEQ ID NO. 8756 and included an ATG start codon at nucleotide positions 326-328 and a TGA stop codon at nucleotide positions 2414-2416; the longest open reading frame (translation frame=2) encoded by SEQ ID NO. 8756 had the amino acid sequence of SEQ ID NO. 8757. An alternatively spliced version of this first novel miRMON18 target gene is SEQ ID NO. 8758 ("SPX_MFS__117961287__2"), which includes an ATG start codon at nucleotide positions 87-89 and a TGA stop codon at nucleotide positions 1137-1139; the longest open reading frame (translation frame=3) encoded by SEQ ID NO. 8758 had the amino acid sequence of SEQ ID NO. 8759.

The second of these novel miRMON18 targets had the sequence of SEQ ID NO. 8760 ("SPX_MFS2", derived from BAC at GI:118200525) and included an ATG start codon at nucleotide positions 201-203 and a TGA stop codon at nucleotide positions 2295-2297; the longest open reading frame (translation frame=3) encoded by SEQ ID NO. 8760 had the amino acid sequence of SEQ ID NO. 8761. An alternatively spliced version of this second novel miRMON18 target gene is SEQ ID NO. 8762 ("SPX_MFS__117961287__2"), which includes an ATG start codon at nucleotide positions 145-147 and a TGA stop codon at nucleotide positions 1189-1191; the longest open reading frame (translation frame=1) encoded by SEQ ID NO. 8762 had the amino acid sequence of SEQ ID NO. 8763.

A third novel miRMON18 target included stitched cDNA sequences from EST data and had the sequence of SEQ ID NO. 8764 (derived from BAC at GI: 126116193) and included two possible ATG start codons at nucleotide positions 217-219 and 1034-1036 and a TGA stop codon at nucleotide positions 2093-2095. Two proteins were predicted from the two possible open reading frames by homology; the first protein (predicted with a frame shift of 1) contained 625 amino acids and had the sequence of SEQ ID NO. 8765, and the second protein contained 353 amino acids and had the sequence of SEQ ID NO. 8766.

The peptides encoded by these novel maize miRMON18 target genes were aligned using ClustalW (version 1.82); the resulting multiple sequence alignment is depicted in FIG. 11, and shows the maize SPX domain (indicated by underlined sequence, where present) and the maize MFS domain (indicated by sequence in bold text).

Additional cloning work from BAC115312385 confirmed the sequence of the first miRMON18 target ("SPX_MFS_117961287", SEQ ID NO. 8756) and yielded the genomic SPX_MFS2 sequence SEQ ID NO. 8767 in which was further identified leader sequence (indicated by italicized text), 5' introns (indicated by underlined text), exons (indicated by upper-case text), and the miRMON18 recognition site (located at nucleotides 2628-2648 of SEQ ID NO. 8767 and indicated by bold upper-case text):

(SEQ ID NO. 8767)
gttacaaggcaatatttttgtagaataaaatcttaaaggaaactcaactc cacgaattggtcacttgcattaaatcatattgtgggtctcttttagttgc atcttaagatggcggcaacaagatttcaagcacttttttatctagtgaccg caatgcactggagataaataagaatccaaatatattttttgataaccttg acactatttaatcttcttataagtgacgaagtagtttgatcaacaataaa aacgtatagatttcaacatttttgcgattgtaggatatatgttagcaaa tattttaagcaaaataatattttatctataatctctatatggattattc tagattttggggaccctatataaaattagctatgagtattaacacttgat aatcttgcctagaatgtcttcgatttctgggtctaccactacacctaact gagtttaaccctgcaataaataattaatctcgtgaaatcatttggagatt ttgactcaatttaaataggtagctactgtgtagttaggttgaaccaggac accaggtgtaacacgagtcacatatgcatgcatgtgtattgactcaatcg gccggcgcacgctatgatggtgctagaaaatgttttatacggctgtgaaa ggtgtaacctgtgctgtgtcgcaaacaatatattgtttaactttgtttgg ccttgaactcctgggggcaaacataagatataaaagatcgatatgcctt catgattccgtcataatctcgaccgtaattaaggcccgctctatataaac ctttaaagcaaattgttagtcatataataatttattagttggattgatgc aacaaataacaactatttatttaagattaactaacttctcagttaaattt agtcactaactattagtttttagaggtttggaacatgttataagaacctaa ccggtctctcaacgttacaaaagctatcatatttgaaccccgtcatcgg agcgcacacgttttatttttgttctgttcatgtctatgctgagatactaaa attttgtgcacaagactacaaggacgagagcacctatgaggtattaatcg gttattcaaattccgtaagagttgggggtattggaagagattattagaat ttttgacctgttaagatttaaacccacttaattttcttgcaacacatactg caggtcctcagatagcgaggcgcagtcgcgcagaccgcagagcgccgaat cgtgagaaggatcagaagtgcttgttacttccgtacgggttagagcatct ccaacaacgtgacctataaaaatgccctataatttgaaaatgagtatatt ttatagaatttagggcaccaacaaaacaccccgctccaacagtaaagccc caaatctagattatagggcagcccactacggtgtagtatatttgagtcac ttgagagggtgccctatagttttttgacaaaattttatgaaatggagcac tgttggagtagttttcctgtgtagagccctatatttcaatttgaggcac tagtttgaggcattgttggagatgctcttacaaatacacggaacatattt gggttcagcaacagggacggacggacggcgcgccgtgttctacagacttg ccgtcgctgcttctgcatctgttcgaaaaccgtaaccccgtgcaccgct ggtcagtagtcgtcgtttcgtttcgtttcgtttcgtcgcggcgatcttcg aaccgatgaagcgtggcacttggctggttggtggtggtacgccgggccag aaggtgacctgcctcgatccgaataccatgcatcgatctgtgcacgtgcc tgttctcttcctactccgattaccgatagtccgggccgggaaaaagagcg cgaagccagatctgaccactagggggtctgtttggttggtttctctcgcca acctggctgtgtgagccaggatcactggagcctggctctgaagatacgac caatctgctcgtatctggtgagcctggcccaaggtgctttaaggatcgtg cgagtctggattcaaatctacatgcagacaaccaaacacagagctcgcac gcgcatagcttggctcatagcaaccaaacagcagctacccgcatcccgcg acgcaagcacgcgcagatgcaggcaaccaaacagaccccaggtgatccag gtcgtcgaatgttccacgcgaaccgcagccgcgagtgccgtctccggctc cgccacaggtagagctcagagcagaaaatgctccagccacctgtctctct tcttcctccttcctgccctgcacgcggctataagtacccaccgccatctc acttttgcccagcagcacggcagtagctgcgccattgcacgcctccggccg gcggctgcttgtcttgctgcttctgccgcacatccgtgatccgtacgtcg tcacctcaccactcacgcacaagcacaaagagcgttaatttcttgctgga gattctattctatttctatggcgtgtccctgatcgaatcctaaatcctaa acctctgtggtgcactgcagggcagaaggtgcttcgttcgttgcaggcct ggcgccacgccgtaccgtgcaagcgCGTTTGCTGATGTTCATCTAA*ttac*

*tgtataataatatctccgggcgaaagagctagcaatcgtcggcgggggag*

*gaggggctcgattgctgctca*aggtgagttgtaattccttggctctggat ttccctatctgttggctgttcatggatcatccaatggatggatggcgctc cctgttctcacacctgcgtgctcttcttccctcgcctcgccgggggtcttg tgtcagttactgtatctccctgttgattttaaaatctaagaagcaacaac aaaagatgattcaaaaaaatattcaaatttgaaggaccacaatgcgtgtg ctactgctagctatgctaccattagagcatgccttcactgcattcttctt cttttgttacgagtgcttaatctcatggctcgctcccttaattcttgcta cccattagagcatcttcaatactttctaaaaaaaaccacttgacaaacta atgaaatcagttggtaaactaataagtttcacgagtgactaaaaaaaaga taggagctagcttctagtcctagataatgctcttatgagctttccttgtc cagttgtcccaactcccaacgaacaaaaaaaaaaggtaagaaaacacat ttggcctttcttcttttttcttttcaactcaaaacgatcgctcagttaca -continued aaaaaaaaagagagcttgcaattgcgagcgagataccaccgttacaggga
aaaaaaagacaagttgttcaagttctctactagcttcctagcgcttccgt
gtcgttctagatgagcttctctagcaaaggacaataatttggttgccacg
tcagatgtcgactcagtgtcatttgctaccagctggcttatcaacttggg
agattattgctcgcacctggacccggtgtccagtcaattattaatgatgt
tgatccatcttcgtattttttatcttggcaagaaactgttagtattaagtt
actgtcacctttggaagctgaatctcccctcgaagatatcagtatgggca
tatagccatccgttcttatacacagctatttacgtctattttacaatttt
atatcttcgtcttcctcttttacacctacattcgaaccatctatttagag
ctttcaatgtgcaattcgtctttggtcattgtcaacatgaaccgtccagt
gataatgctttgatgctgactaagaagtacggtctccggttcttaaatat
ttattgtctaatattttattttttaaaataaaacatgataaataaaaaagaa
cggagtgagtagaatacattgtgagctgttgttggtttgttgcacattct
ttacttgtttttttttacgaacatttgttgcaagcatcagcaaagccgta
taaacttgtgcagctctagatagcgatttttttaaacaaaaccttaatat
tagattttggagcattgatttagaaagctgagcaactccaatgggagagg
tgtttatttctcgtccatccacatccgccgttggcccgttgtttctttt
ctacccgcgcctgtggggcccaaccgtccggtcaaccgaccagcgtttcc
tgttccaccgtacgtcgtcgttctcgttcggtcgttttcgttccctacc
tccagtccagtccaggtccgagccggaccttgatcgccgccgtgcctcg
cgcaaggaatggggccttcggtcttacccttgcacgcgccgccggcatca
ggagacgtctctgtgtgcttcgccgtgccttcagccgtagccggcgccgc
atcagcgtgctccagagaggaccgcagcttccagcacgtgtccctgacac
cgccccacactggattgggaagggccgctgaccccacgcacctgcccgct
ggccagtgttggaaggtttgggaaatgagatgttgattttaagctgactt
ttgagggttttagcttacagctttttaaatcaatcttcgaccaacggttt
gaaattccgtgtttagagttgaattactcgattcagaagtttaagtttct
ctaatttaagctaaagggagaagagatggagcgcctggcttgagttggcc
gcacgcagctgggaagaaggatctgaaaacactgtcgtccatgtattgat
tcacttaaacatttgtccgtatctattattttaattttttttataatctac
ggtcacaagatatgcctgtgttgttgtgaatagaaaacactgaacaatg
attgtgagtcaacagctatcattatttgtgttttggttgtgcgagggtat
actaatgtctaatgattggctaaaccttagtcttacatcgctgtctttcc
ttgcgctgtagggcaaggcaaccaccaattgggtaaaagcatataagcag
gcttaccgatcaataaatataaaaagggtagctttcaagaagtctgctt
atgtaataccattattttccttttttttttacctcgaaggagtgataatcac
caaaatagcattatattgtcatcatacggctgcactatcttttttcttctg
taacatgccgtctaattattatcttcagtttcagactcagttatttgaaa
catcaagATGGTTAATTTCGGAAAGAAATTGATGGCTGATCAAGTGGACG
AATGGAAAGGGtatgactttcttttggtacttatgaaatcatctattttt atcttatcagggcaaatgttcttattttcatatatgcccactccactagt
ccactaggatacattagaacaccataccgtagttatcaccatatcacagt
ccttactatcattatctggttaattttataattaaattaaacaaaatcta
gcagttatcgaattgataggttgcactacaataatgaagtcacttcccgc
taatgcaagctaatgtcactttgtttaacggtttatcagaaatcttatca
gcttttggtctttccatttctagatactacatcaattacaagaaatctt
atcagcttttggtctttccatttctAGATACTACATCAATTACAAGCTG
ATGAAGAAATGTTAAAGCAATATGTCCAACAAACCCAACATGATGAGAA
AGATCGCGAACAAGTTCTTAAAGACTTTTCAAGGTTTCTTGATGAccagg
tatacaaagaaagattcccttgaaatgatcataatatatgattttgagc
atcatctatcctgtcagtagtcacttgtatccttgtaaggaacagaacag
tgtcatgcgacaagcttaatagtcttagtgaatgggatcattttctta
gttgtgagctaaaatacacatgtatttcttcgttCCAGATTGAAAGGATT
GTGCTTTTTCTGCTACAACAACAAGGCCATCTTGCCAGTAGGATTGAGAA
ATTGGCAGAAAACGCACTGCTCTTCTGGAAGAGTATGACATATCACAAG
TTTATCAGCTGCATGATGCATACAGGGAAGTCGGGCTTGATCTCATAAAG
CTTCTCCGCTTTGTTGATGTGAATGCTACTGGTATACGCAAGATACTAAA
GAAATTTGATAAACGCTTTGGCTACAAGTTCACTGATTATTATGTCACCA
CTCGTGCAAATCATCCTTATTCTCAGCTTCAGCAAGTATTTAAGCAAGTG
Gtaattttcatgcattttgcattttcctttcttgatgtgtgaagtaattc
ccagtacctattatttatcatggactcatacggatgcaggGAATTGTAGC
TGTTGTAGGTGCATTATCGCGCAACCTTGAATATCTGCAGCATCATGAAG
GAAGCTTTGTATCCATCTATGATCGTCCAGCAGTTACCTTGAaggtattc
tattttcactattccattctcatttcagaaattctgctattgaatttata
aatgaaaaccttgaaaggtgctctttcttacctcggaactgcatcaatta
tatttccacatgaagtagggtgtgacatgacactttttgttgttatatt
cAGGACCCTATTATAGACCAAGTAAACCATGCAGTACAGAAACTCACGCA
TGCCACGAATTTTATGCAATTCTTGGGACAGCACGCGCTTATTGTCCAGG
AAGATGCAGAAAGCGAGTCGGAGGATCTTGTTGGTGATCAGAGCTACCAT
TTCATGTCCCTGGTGCTTAATCTAGTGAACACATTCCTTTACATGGTGAA
TACATATATCATTGTGCCGACTGCAGATGACTATGCAGTAAGCCTTGGGG
CTGCTGCAACTGTATGTGGTATAATTATTGGATCGATGGCAGTCGCCCAA
GTATTCTCCTCAGTCTACTTCAGTGCCTGGTCAAATAAGTCCTACTTCAA
ACCTCTTGTGTTCAGTAGCATTATGCTGTTTCTTGGAAACCTACTGTATG
CATTGGCATATGATCTGAATTCACTAATAGTTCTCCTGACTGGACGACTG
CTATGTGGGTatgcaattttctcaattcactctatctcacttgatttacg
ttccacttttgtatgctagcattgatctgggtgaaaattactagtatgac
aaatgcaggttgaggatccttaagctgagggcaatattctagaatattta
tattgctgaatagaaaacaaaatggaaactgtatatcttacaaggagata
aaggattttaaatctcgagactggcattaaaatatatgcttttctatttc ttttatagaacttaactagttatccctacctcccttttgggctagtaattt gtctatattgtttaaggttcttgattttctgacggtgcatctgtgatcga gctgccagcatgtaatgtgcaggtTAGGTTCTGCAAGAGCAGTGAACCGT

CGCTATATCAGTGACTGTGTGCCTCTCAAGATGAGGCTACAAGCCTCTGC

CGGGTTCGTTAGTGCTAGCGCTCTTGGCATGGCATGTGGCCCTGCTCTTG

CTGGTTTTCTCCAGATTAAATTCAAGATATACTCGCTCAGTTTTAATCAG

AGCACATTGCCTGGATGGGTCATGRGCATTTCTTGGCTTATTTACTTATT

GTGGTTGTGGCTTACATTCAAGGAACCAGAACACTTCACTAAAACTCTGG

TCAATGAACAGCCGTCAGAATCTGGtaagctaacaatacactgaaatggc aacatgttttgtttgaattcatgaatatgctcgaatcaaaccttattgta caatcaggatgtgtatgcttatcattcttaggaacttttctgagatgttt atttccttattatgaaaataggCCGCCAAGGAAATTCTAACTTGGAGGCA

GGTCTAGCTGAACCATTGCTTCAAGGTATAGAACGAAGGCAGGATGAGAA

CTCAGAAGTTATGATGATACTGAAGTAGAGTCAGAAAGCTCTCATGAACC

AGCAACATCAATTGCTTCAGCATACAGATTGCTAACTCCATCTGTGAAGG tttccttcccctcccttcccaattatcgattttcttgtcttgttctt ggttcaaacgtttgaaagaaagaagctcacaatctacatagggttctttt gtaaataaagttagataaattaactatataatataataaaactgcatctt taaatagtaatgggtaaatacattccagttactagtaggtacatctgcat gtcatacaagcaaacataacggacacgccatgtaaaagaaactaggccaa cctaggagaaactaggttgcatttattattatattattattaagatgaaa ataggcacccaaatttaccttgacaaggacttgaacctaggtggtctggg tttacgagcacaccttgaccaagtgagctagctcagttcccttgacaca ccagccagatgaaaagttgcatgtgcagctacccctttttccacgccttt tcatcttccaatctttgttggagctaccttctcatgtattcatatcttta aaaaatggttgtttgtcAGGCCCAGCTACTGATATACTTCATGCTCAAGT

ACGCAATGGAAATACTACTATCAGAATCGAGCGTTGTCACCACATACTAT

TTTAGCTGGTCTACAAGTGCTGTGGCTATCTTTCTAGCGATTCTTGGATT

AACGGTTCTTCCAGTAAATGCCATTGTTGGAAGCTACGTTACAAATTTAT

TCGAGGATAGGtaagctttgtactcttacaaaacatactacatgaaactt ttatattctctagacattgtttttctcttaaactgagacatgctttcaca aaataacttgctctatcatttgcaggCAAATTTTGTTGGCATCTGAAGTC

ATGGTTCTCATCGGTATAATCATGAGCTTTTGTTTCACACCTCACTACTC

CATCCCGCAATATGTTCTTTCAGCTTTCATCACATTTGTATTTGCTGAGG

TGCTTGAaggtatgtatgtttatatacattaatggtttgagacagcgaaa cctaaatcaatcatacgctgctgatttatcagccactcaacttctaacct cgagctatgcAGGAGTGAATCTGTCCTTGCTCTCACGAGTAATGTCATCG

AGGCTTTCCCGAGGGACCTACAATGGTGGACTCCTTTCGACAGAGGCCGG

GACGTTGGCCCGTGTAGTTGCAGATGCCACGATTACTGCAGCCGGTTATC

TCGGCACGGACCTCCTTCTGAATGTCACTCCTTCTCCCATCCCTTGTGAT

TTGCATAGTCTCCATCGCAGCAGCACTCTACACTTACAACAATCTCTATT

GAagctattgttgctgtacaagtgtacaacaatgttcctaagctaaaatg ttcctgcccacaacgggtttgtatatctgttcaagcatggtttgtaaaca ttttgatcaagtttgtatgcaaaatttcttgtatttagtgcatttatgta aagattcatcctgtaaagaattataaactatgagacgctattgccattta tgatcatttatgtttatcttttttagccttatgttatttgaatttgtctaa tcaatgccatcttccatcacgagcacatcattgacatattactgatggat agaccttttgggacgtgagatgctaaaggcacaacctatatagctgaaa atttctaacatatttatcaataataccaagatgcctttgttgtttatcaa ttgcacattatttcaacgtaaatgcaattttgttaaatatgtcatggtgt cgagcctactgcttaccccagcatgttgaattgctgccttaagcagaaac atcgaaaaacctgcgtagattccacgatccaacaatcctctccgttcatt tttttagttccatatgaaaggaccgattacgtctgaaagaagagtttcat tagacaatctatttcttttaactaatgcctctagttttttcaaaacctatg caataaataggtgtaactatagttttgactaagggttgtaatctctttgt aaaatatttatgcaatctcgatttcaaatctatccactagcctaacaact aataagataaaacatacaaccaagatacataatataaatacgggagctta aatacgatatacatataaactcttattgatgactccattgtttttatcga gataccaagaaagacgcaagtttctccctagtcctcattggagcccagtc cgcgcgagtaccaagctctcggtcaggtaacattgtggatagcctaggtt ttttgccacacacaagtgggtctttagtgtagcctcttctaaatgctctc tatcaaaggtggtccaggaaaagattcaaaatgggccctagcagtagta gtattactactaacaacaataatgataaataagtaaatgctcaatgtgca taaaattgatctaagaagtacttgtaaactcatgtaatgttgtaaactta tttgcttatttcttatgtttcttttctcacatccgaacagattccttcta gaggacatgattgtaagttaaaaaataaaatagaacactaattaaatcaa agctatcgctacttgctgagttacaaaattattaaatctatttataaaat actaccaattatgtcgtacttccaaattatcaaacaattgaatagattac aaaataatatttaatcaatagattacaaaatacctactacaaattcacaa aacaatttgtctagtttagtaattattcaaactatagttgtacatagtaa ttaatttggctttggtttagaccctcggccttggtgaacgacgaacaacg aggtatcctatgtgtagtcatgtatgatgcgtctaggatgtagatgcagt ggccagtggcaatcctcagtcttcacgaatcaggatgaacataggagggt ggggcctcgcggaatagggggactagggta.

T1GR transcript databases were searched for SPX:MFS domain coding sequences for SPX genes. Identification of such genes supports the existence of a conserved regulatory pathway in higher plants. Putative miRMON18 target sites were found by searching for a conserved sequence complementary to miRMON18 in the 5' untranslated region upstream of the start codon. A putative mirMON18 target (TA40434_29760) was identified in grape (*Vitis vinifera*) with the sequence of SEQ ID NO. 8768, with the miRMON18 recognition site located at nucleotides 323-343 of SEQ ID NO. 8768. Similarly, a miRMON18 target (TA5852_4236)

was identified in lettuce (*Lactuca sativa*) as having the sequence, SEQ ID NO. 8769, with the miRMON18 recognition site located at nucleotides 64-84 of SEQ ID NO. 8769.

Figure 12:
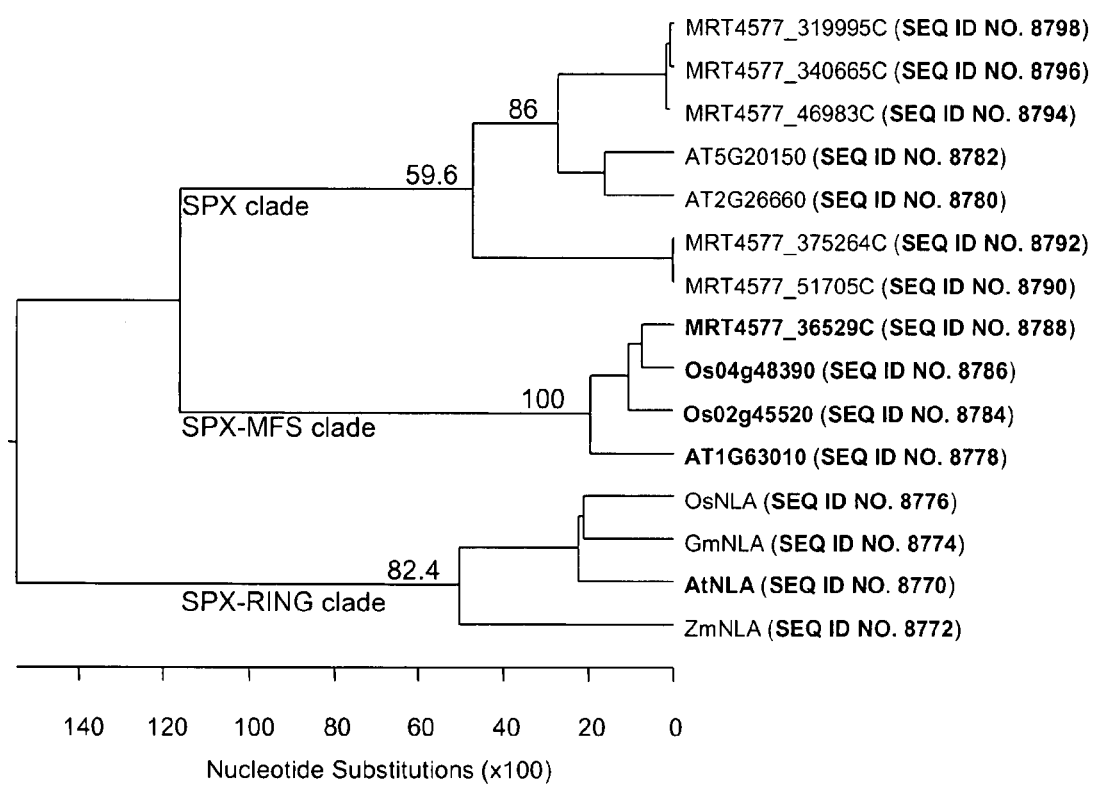
FIG. 12 depicts a phylogenetic tree constructed for the identified SPX genes, as described in Example 7; genes containing a predicted miRMON18 recognition site (in genes from species other than *Arabidopsis thaliana*) or a predicted miR827 recognition site (in genes from *Arabidopsis thaliana*) that has been experimentally validated are indicated in bold text.

Orthologous SPX-domain-containing genes including NLA-like genes were identified in various species including maize, rice, and soybean. Where sequence was available, putative miRMON18 or miR827 target sequences (recognition sites) were identified in the 5'UTR. FIG. 12 depicts the phylogenetic tree constructed for the identified SPX genes using amino acid sequences aligned by ClustalW, with bootstrap values determined using 10000 iterations; genes containing a predicted miRMON18 recognition site (in genes from species other than *Arabidopsis thaliana*) or a predicted miR827 recognition site (in genes from *Arabidopsis thaliana*) that has been experimentally validated are indicated in bold text. In addition to the *Arabidopsis thaliana* NLA gene AtNLA containing the SPX and RING domains (MRT3702_101115C, At1g02860, SEQ ID NO. 8770, which includes a miR827 recognition site at nucleotides 135-155, and encodes the protein with the sequence of SEQ ID NO. 8771), the genes included in the phylogenic tree are the maize NLA-like gene ZmNLA (SEQ ID NO. 8772, encoding the protein with the sequence of SEQ ID NO. 8773), the soybean NLA-like gene GmNLA (SEQ ID NO. 8774, encoding the protein with the sequence of SEQ ID NO. 8775), the rice NLA-like gene OsNLA (SEQ ID NO. 8776, encoding the protein with the sequence of SEQ ID NO. 8777); the *Arabidopsis* sequences At1g63010 (SEQ ID NO. 8778, which includes a miR827 recognition site at nucleotides 153-173, and encodes the protein with the sequence of SEQ ID NO. 8779), AT2g26660 (SEQ ID NO. 8780, encoding the protein with the sequence of SEQ ID NO. 8781), and AT5g20150 (SEQ ID NO. 8782, encoding the protein with the sequence of SEQ ID NO. 8783); the rice sequences Os02g45520 (SEQ ID NO. 8784, which includes a miRMON18 recognition site at nucleotides 395-415, and encodes the protein with the sequence of SEQ ID NO. 8785) and Os04g48390 (SEQ ID NO. 8786, which includes a miRMON18 recognition site at nucleotides 334-354, and encodes the protein with the sequence of SEQ ID NO. 8787); and the maize sequences MRT4577_36529C (SEQ ID NO. 8788, which includes a miRMON18 recognition site at nucleotides 1660-1680, and encodes the protein with the sequence of SEQ ID NO. 8789), MRT4577_51705C (SEQ ID NO. 8790, encoding the protein with the sequence of SEQ ID NO. 8791), MRT4577_375264C (SEQ ID NO. 8792, encoding the protein with the sequence of SEQ ID NO. 8793), MRT4577_46983C (SEQ ID NO. 8794, encoding the protein with the sequence of SEQ ID NO. 8795), MRT4577_340665C (SEQ ID NO. 8796, encoding the protein with the sequence of SEQ ID NO. 8797), and MRT4577_319995C (SEQ ID NO. 8798, encoding the protein with the sequence of SEQ ID NO. 8799).

Several kilobases of sequence were available upstream of the maize and rice NLA-like coding sequence, within which a miRMON18 target site was not identified from preliminary sequencing efforts. Based on expression profiling data it appears that ZmNLA (SEQ ID NO. 8772) RNA level does not respond to nitrogen availability. In contrast, the SPX-MFS domain clade (SEQ ID NO. 8788, SEQ ID NO. 8786, SEQ ID NO. 8784, and SEQ ID NO. 8778) shown in FIG. 12 is suppressed under sufficient nitrogen in maize and *Arabidopsis* and is predicted to be regulated by miRMON18; sequences in this clade contain an experimentally validated miRMON18 (or miR827) recognition site. The SPX clade shown at the top of the tree (SEQ ID NO. 8798, SEQ ID NO. 8796, SEQ ID NO. 8794, SEQ ID NO. 8782, SEQ ID NO. 8780, SEQ ID NO. 8792, and SEQ ID NO. 8790) (FIG. 12) contains only an identifiable SPX domain, is suppressed by limiting nitrogen, and is also predicted to be regulated by miRMON18. In maize, the TxP data corresponding to genes in clade 1 (SEQ ID NO. 8798, SEQ ID NO. 8796, SEQ ID NO. 8794, SEQ ID NO. 8792, and SEQ ID NO. 8780) were correlated to miRMON18 precursor expression; expression of both the miRMON18 precursor and of clade 1 genes was upregulated under conditions of nitrogen sufficiency. Genes in the SPX-MFS clade 2 (SEQ ID NO. 8788, SEQ ID NO. 8786, SEQ ID NO. 8784, and SEQ ID NO. 8778) are directly suppressed by miRMON18, whereas clade 1 genes lack a direct target, suggesting that miRMON18 may indirectly regulate clade 1 gene expression through suppression of clade 2 genes.

Example 8

This example describes identification of a crop plant miRNA (miRMON18) promoter having an expression pattern characterized by strong expression under nitrogen-sufficient conditions and suppression under nitrogen-deficient conditions, or strong expression under phosphate-sufficient conditions and suppression under phosphate-deficient conditions Further characterization of the maize miRMON18 gene involved BLAST matching of a miRMON18 precursor (SEQ ID NO. 3936) to cDNA libraries and microarray elements, and inverse PCR cloning of a miRMON18 genomic sequence (SEQ ID NO. 8800) from maize (*Zea mays* var. *LH*244) using inverse PCR primers based on a cDNA sequence (SEQ ID NO. 8801) from clone L1B5025-018-A1-XP1-B6. This miRMON18 genomic sequence (SEQ ID NO. 8800) had the annotated sequence depicted in FIG. 13, where the miRMON18 transcript is given in upper-case text at nucleotides 2173-2788 of SEQ ID NO. 8800. This genomic sequence also included a miRMON18 promoter element in lower-case text at nucleotides 211-2172 of SEQ ID NO. 8800, a leader element in lower-case text at nucleotides 2173-2308 of SEQ ID NO. 8800, a canonical TATA box (ending 25 nucleotides upstream of the transcription start site) in underlined lower-case text at nucleotides 2144-2147 of SEQ ID NO. 8800, the mature miRMON18 as underlined-upper-case text at nucleotides 2419-2439 of SEQ ID NO. 8800, and the miRMON18* as underlined upper-case text at nucleotides 2322-2341 of SEQ ID NO. 8800.

To verify the expression pattern of the miRMON18 promoter, two recombinant DNA constructs (SEQ ID NO. 8802 and SEQ ID NO. 8803) were constructed in a binary vector that included a rice actin 1 promoter driving neomycin phosphotransferase II (nptII) as a selectable marker. The construct (SEQ ID NO. 8802) in plasmid pMON111971 included a miRMON18 promoter (SEQ ID NO. 8804) and a miRMON18 leader sequence (SEQ ID NO. 8805) driving expression of a GUS gene (SEQ ID NO. 8806) followed by a NOS terminator sequence (SEQ ID NO. 8807). The construct (SEQ ID NO. 8803) in plasmid pMON111967 contained a DnaK intron (SEQ ID NO. 8808) and also included a miRMON18 promoter (SEQ ID NO. 8804), a miRMON18 leader sequence (SEQ ID NO. 8805), a GUS gene (SEQ ID NO. 8806) followed by a NOS terminator sequence (SEQ ID NO. 8807). The vectors are transformed into maize using *Agrobacterium*-mediated transformation and antibiotic selection using standard techniques as described under the heading "Making and Using Non-natural Transgenic Plant Cells and Non-natural Transgenic Plants". Strong miRMON18-promoter-driven expression of GUS is observed in transformed maize leaves under nitrogen-sufficient and phosphate-sufficient conditions. GUS expression is suppressed in the transformed maize leaves under nitrogen-deficient or phosphate-deficient conditions.

Alternative miRMON18 promoter sequence useful for driving expression of a transgene with the expression pattern of the native miRMON18 gene (i.e., strong expression under nitrogen-sufficient conditions and suppression under nitrogen-deficient conditions, or strong expression under phosphate-sufficient conditions and suppression under phosphate-deficient conditions) include the promoter having the sequence of nucleotides 211-2172 of SEQ ID NO. 8800; a fragment of at least about 50, at least about 100, at least about 150, at least about 200, at least about 300, at least about 400, or at least 500 contiguous nucleotides having at least 85%, at least 90%, at least 95%, or at least 98% identity to nucleotides 211-2172 of SEQ ID NO. 8800, wherein the fragment has promoter activity in at least one plant tissue that is characterized by strong expression under nitrogen-sufficient conditions and suppression under nitrogen-deficient conditions or strong expression under phosphate-sufficient conditions and suppression under phosphate-deficient conditions; and a fragment of at least about 50, at least about 100, at least about 150, at least about 200, at least about 300, at least about 400, or at least 500 contiguous nucleotides having at least 85%, at least 90%, at least 95%, or at least 98% identity to SEQ ID NO. 8804, wherein the fragment has promoter activity in at least one plant tissue that is characterized by strong expression under nitrogen-sufficient conditions and suppression under nitrogen-deficient conditions or strong expression under phosphate-sufficient conditions and suppression under phosphate-deficient conditions. Identification of alternative promoter sequences is confirmed by routine techniques, such as verification of a TATA box within the promoter sequence and validation of promoter activity in at least one plant tissue (e.g., by testing a recombinant DNA construct including the promoter driving expression of a reporter gene such as GUS or luciferase in either transient expression experiments or in stably transformed plants).

Example 9

This example describes identification of recognition sites of a crop plant miRNA (miRMON18) having an expression pattern characterized by strong expression under nitrogen-sufficient conditions and suppression under nitrogen-deficient conditions, or strong expression under phosphate-sufficient conditions and suppression under phosphate-deficient conditions. Also disclosed are methods of use of the miRNA, the miRNA promoter, and a miRNA recognition site. Non-limiting examples including a method of providing a non-natural transgenic crop plant having improved yield under nitrogen or phosphate deficiency by expressing in the transgenic crop plant a recombinant DNA construct including a miRMON18-unresponsive transgene, and a method of providing a non-natural transgenic crop plant having improved yield under nitrogen or phosphate deficiency by expressing in the transgenic crop plant a recombinant DNA construct including a miRMON18 recognition site that has been added to the sequence of a normally miRMON18-unresponsive gene.

Figure 14:
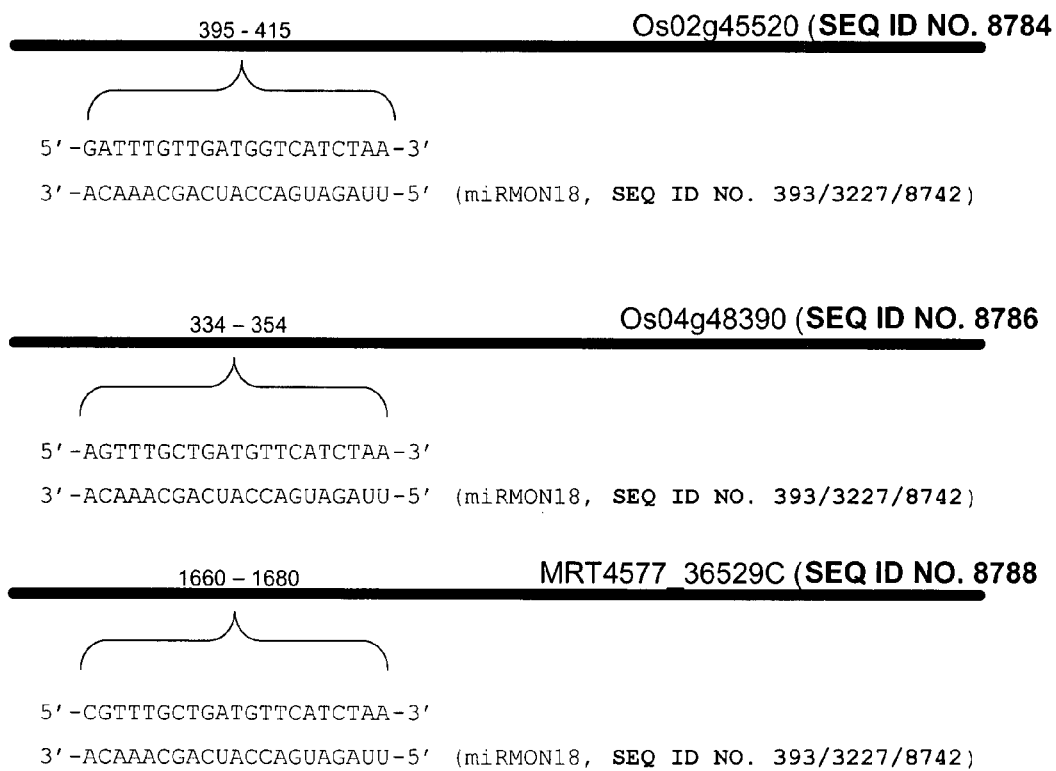
FIG. 14 depicts the predicted cleavage by miRMON18 of the rice sequences Os02g45520 (SEQ ID NO. 8784) and Os04g48390 (SEQ ID NO. 8786) and the maize sequence MRT4577_36529C (SEQ ID NO. 8788), as described in Example 9.

Prediction of a recognition site is achieved using methods known in the art, such as sequence complementarity rules as described by Zhang (2005) *Nucleic Acids Res.,* 33:W701-704 and by Rhoades et al. (2002) *Cell,* 110:513-520. One non-limiting method to experimentally validate predicted miRNA recognition sites is the technique known as RNA ligase-mediated rapid amplification of cDNA 5' ends ("5' RLM-RACE"), which identifies miRNA cleavage patterns; see, for example, Kasschau et al. (2003) *Dev. Cell,* 4:205-217, and Liave et al. (2002) *Science,* 297:2053-2056. This approach relies on ligation of an RNA adapter molecule to the 5' end of the cleavage site and is dependent on the 5' phosphate left by RNase III enzymes including Ago1. The resulting PCR products are sequenced and the relative number of clones which align to the predicted miRNA cleavage site between nucleotides 10 and 11 relative to the miRNA 5' end provide an estimate of miRNA activity. FIG. 14 depicts the predicted cleavage by miRMON18 of the rice sequences Os02g45520 (SEQ ID NO. 8784) and Os04g48390 (SEQ ID NO. 8786) and the maize sequence MRT4577_36529C (SEQ ID NO. 8788). Results from 5' RLM-RACE assays were used to confirm cleavage of the predicted miRMON18 recognition sites (target sites) in the rice sequences Os02g45520 (SEQ ID NO. 8784) and Os04g48390 (SEQ ID NO. 8786), for which 3 of 24 clones and 13 of 16 clones, respectively, were sequenced and found to have the predicted cleavage pattern (between nucleotides 10 and 11 relative to the miRMON18 5' end). 5'-RACE experiments also partially validated the miRMON18 recognition site in the maize SPX_MFS2 sequence SEQ ID NO. 8767 (data not shown).

Another non-limiting method to experimentally validate predicted miRNA recognition sites is to examine expression levels of the putative target, e.g., by transcription profiling experiments. The expression level of a true target of a miRNA would be predicted to be high when the miRNA is not expressed, and low when the miRNA is expressed. Thus, a miRMON18 target would be predicted to have higher expression when miRMON18 is not expressed (i.e., under nitrogen-deficient or phosphate-deficient conditions), and low expression when miRMON18 is expressed (i.e., under nitrogen-sufficient and phosphate-sufficient conditions). FIG. 15B depicts expression profiles of the maize sequence MRT4577_36529C (SEQ ID NO. 8788), which contains a predicted miRMON18 recognition site. MRT4577_36529C (SEQ ID NO. 8788) was unaffected by water availability or temperature (with no large differences in transcript levels seen between water sufficient or drought conditions or between cold or normal temperatures; data not shown), but exhibited higher expression levels under nitrogen-deficient conditions than under nitrogen-sufficient conditions, i.e., an expression pattern opposite to that of miRMON18 as shown in FIG. 15A (also see FIG. 9 and FIG. 10), indicating that MRT4577_36529C (SEQ ID NO. 8788) is indeed regulated by miRMON18.

These data verify that miRMON18 regulates conserved SPX-domain-containing genes. Expression of miRMON18 is suppressed during nitrogen deficiency or phosphate-deficiency, allowing the endogenous miRMON18-regulated genes to be expressed under these conditions. Manipulating the expression of either the mature miRMON18 miRNA or of miRMON18 targets (genes including at least on miRMON18 recognition site) is useful in altering a plant's response to nitrogen deficiency or phosphate deficiency.

One aspect of this invention includes a method of providing a non-natural transgenic crop plant having improved yield under nitrogen or phosphate deficiency by expressing in the transgenic crop plant a miRMON18-unresponsive transgene. One embodiment is expressing in a non-natural transgenic crop plant a recombinant DNA construct comprising a synthetic miRMON18-unresponsive transgene sequence, wherein the synthetic miRMON18-unresponsive transgene sequence is: (a) derived from a natively miRMON18-responsive sequence by deletion or modification of all native miRMON18 miRNA recognition sites within the natively miR- MON18-responsive sequence (that is to say, eliminating or changing nucleotides of the natively miRMON18-responsive sequence that are recognized by a mature miRMON18 miRNA having the sequence of SEQ ID NO. 393, SEQ ID NO. 3227, or SEQ ID NO. 8742 or by a mature miRMON18 miRNA derived from a miRMON18 precursor sequence selected from SEQ ID NO. 1763, SEQ ID NO. 3936, and SEQ ID NO. 8800), and (b) is not recognized by a mature miRMON18 miRNA. In a non-limiting example, the miRMON18 recognition site in any of the conserved SPX-domain-containing genes depicted in FIG. 12 is deleted or modified such that the modified SPX gene is not recognized and bound by an endogenous mature miRMON18 (SEQ ID NO. 393, SEQ ID NO. 3227, or SEQ ID NO. 8742) and is thereby decoupled from miRMON18 regulation and thus from the influence of nitrogen or phosphate deficiency. In a non-limiting specific example, the maize gene MRT4577_36529C (SEQ ID NO. 8788) can be decoupled from miRMON18 regulation and thus from the influence of nitrogen or phosphate deficiency by expression of a modified MRT4577_36529C gene wherein the miRMON18 recognition site in its 5' untranslated region (nucleotides 1660-1680 of SEQ ID NO. 8788) has been deleted or modified such that the modified MRT4577_36529C gene is not recognized and bound by a mature miRMON18 (SEQ ID NO. 393, SEQ ID NO. 3227, or SEQ ID NO. 8742). The modified miRMON18-unresponsive MRT4577_36529C is expressed using constitutive or tissue-specific promoters in maize, increasing nutrient uptake and utilization under nitrogen-sufficient and phosphate-sufficient conditions and resulting in improved yield under normal conditions and preferably also under nitrogen-deficient or phosphate-deficient conditions.

Alternatively, the miRMON18 recognition site is engineered into normally miRMON18-unresponsive genes that are to be suppressed under nitrogen-sufficient conditions and expressed during nitrogen-deficient conditions; this is a useful approach, e.g., with a nitrogen-transport gene that gives increased performance or yield when expressed under nitrogen- or phosphate-limiting conditions, but provides no benefit when expressed under non-limiting conditions.

Example 10

Additional non-limiting examples of methods and recombinant DNA constructs useful in improving nitrogen or phosphate utilization based on manipulating miRMON18 or SPX gene expression are described below.

(A) Modulation of SPX gene expression to improve nitrogen utilization under limiting conditions. In this embodiment, a SPX-domain-containing gene engineered to lack a miRMON18 recognition site (or in *Arabidopsis thaliana*, a miR827 recognition site) in the 5' UTR is expressed in plants. Decoupling the SPX gene from endogenous miRMON18 (or in *Arabidopsis thaliana*, miR827) regulation provides adaptation to nutrient availability under nitrogen- or phosphate-sufficient conditions, and result in increased yield. One desirable result of increasing expression of the SPX-MFS clade (SEQ ID NO. 8788, SEQ ID NO. 8786, SEQ ID NO. 8784, and SEQ ID NO. 8778) (FIG. 12) is the increase of protein content in at least one plant tissue (such as leaf, stalk, root, or seed) during nitrogen- or phosphate-sufficient conditions through increasing nutrient availability in sink tissues. Several vectors (see Table 7) are evaluated in *Arabidopsis thaliana* to model the function of SPX genes.

The predicted phenotype of upregulating AtNLA (At1g02860, containing an SPX-RING domain, SEQ ID NO. 8745) in a plant is constitutive adaptation to low nitrogen or low phosphate conditions and improvement of overall transport and utilization of nutrients by the plant; a similar phenotype is predicted for upregulating the related genes in the SPX-RING clade (SEQ ID NO. 8772, SEQ ID NO. 8770, SEQ ID NO. 8774, and SEQ ID NO. 8776) (FIG. 12). Vector numbers 1 through 5 are chimeric transcripts including non-targeted 5' and 3' untranslated regions and the coding region of AtNLA (SEQ ID NO. 8745); vector number 6 includes a genomic AtNLA (SEQ ID NO. 8745) fragment including the sequence from the endogenous AtNLA promoter through the termination sequence (to prevent ectopic expression) but where the native miR827 recognition site has been deleted or modified to prevent recognition by a mature miR827.

The predicted phenotype of upregulating SPX-MFS clade genes (SEQ ID NO. 8788, SEQ ID NO. 8786, SEQ ID NO. 8784, and SEQ ID NO. 8778) (FIG. 12) is increased nutrient (especially nitrogen and/or phosphate) transport, particularly from source to sink tissues, resulting in increased yield. Vector numbers 7, 9, and 10 are chimeric transcripts including non-targeted 5' and 3' untranslated regions and the coding region of At1g63010 (SEQ ID NO. 8778); vector number 8 includes a genomic At1g63010 (SEQ ID NO. 8778) fragment including the sequence from the endogenous At1 g63010 promoter through the termination sequence (to prevent ectopic expression) but where the native miR827 recognition site has been deleted or modified to prevent recognition by a mature miR827; vector number 11 is a chimeric transcript including non-targeted 5' and 3' untranslated regions and the coding region of Os04g48390 (SEQ ID NO. 8786); vector number 12 includes a genomic Os04g48390 (SEQ ID NO. 8786) fragment including the sequence from the endogenous Os04g48390 promoter through the termination sequence (to prevent ectopic expression) but where the native miRMON18 recognition site has been deleted or modified to prevent recognition by a mature miRMON18 (or in *Arabidopsis thaliana*, by a mature miR827).

The effects of upregulating genes from the SPX clade of unclassified function but predicted to be repressed by low nitrogen availability is evaluated by expression of MRT4577_319995C (SEQ ID NO. 8798) with vectors 13-15 (Table 7).

Similar expression experiments are conducted in maize. Vectors (Table 7) including genes with a conserved SPX domain (see FIG. 12) are constructed and transformed into maize. Vector variants include a vector including the SPX gene's genomic sequence and vectors including the SPX gene's cloned cDNA driven by the native promoter. In non-limiting examples, vectors 16-18 use the coding sequence from MRT4577_36529C (SEQ ID NO. 8788), and have a disrupted miRMON18 recognition site, permitting expression of the transgene under sufficient nitrogen only where the native promoter is expressed. A third construct to express only the MFS domain from MRT4577_36529C (SEQ ID NO. 8788), which represents a native alternatively spliced isoform lacking SPX, will also be made and tested for nitrogen-assimilation in maize.

TABLE 7

| Vector No. | Construct* | Predicted expression pattern |
|---|---|---|
| 1 | 35S: AtNLA | constitutive |
| 2 | 35S: AtNLA lacking SPX domain | constitutive |
| 3 | 35S: AtNLA lacking RING domain | constitutive |
| 4 | FDA/PPDK: AtNLA | leaf-specific |
| 5 | RCc3: AtNLA | root-specific |

TABLE 7-continued

| Vector No. | Construct* | Predicted expression pattern |
|---|---|---|
| 6 | AtNLA promoter: AtNLA with disrupted miR827 recognition site | native AtNLA expression |
| 7 | 35S: At1g63010 | constitutive |
| 8 | At1g63010 promoter: At1g63010 with disrupted miR827 recognition site | native At1g63010 expression |
| 9 | 35S: At1g63010 lacking SPX domain | constitutive |
| 10 | 35S: At1g63010 lacking MFS domain | constitutive |
| 11 | 35S: Os04g48390 | constitutive |
| 12 | Os04g48390 promoter: Os04g48390 with disrupted miRMON18 recognition site | |
| 13 | 35S: MRT4577_319995C | constitutive |
| 14 | FDA/PPDK: MRT4577_319995C | leaf-specific |
| 15 | RCc3: MRT4577_319995C | root-specific |
| 16 | Promoter ZmSPXMFS:ZmSPXMFS cDNA:Terminator ZmSPXMFS | |
| 17 | Promoter ZmSPXMFS:ZmSPXMFS gDNA:Terminator ZmSPXMFS | |
| 18 | Promoter ZmSPXMFS:ZmMFS cDNA:Terminator ZmSPXMFS | |

*35S, cauliflower mosaic virus (CaMV) 35S promoter; FDA, fructose bisphosphate aldolase promoter (bundle sheath promoter); PPDK, pyruvate orthophosphate dikinase promoter (mesophyll cell promoter); RCc3, promoter of rice RCc3 gene (root specific promoter)

(B) Gene expression under sufficient nitrogen utilizing a MIRMON18 promoter. In this embodiment, a miRMON18 promoter is utilized to eliminate undesirable phenotypes (off-types) resulting from expression of transgenes under limiting nitrogen. For example, when nitrogen is not limiting the expression of asparagine synthetase gives a desirable high-protein phenotype. Under limiting nitrogen, overexpression of asparagine synthetase causes a yield reduction. Expression of asparagine synthetase driven by the MIRMON18 promoter gives a high-protein phenotype under sufficient nitrogen availability, yet under limiting nitrogen the transgene is turned off preventing the yield penalty. Vectors are constructed including the maize miRMON18 promoter (SEQ ID NO. 8804), maize miRMON18 leader sequence (SEQ ID NO: 8805), and a miRMON18 foldback structure fused to an asparagine synthetase gene. Non-limiting examples of an asparagine synthetase gene include a soybean (*Glycine max*) asparagine synthetase (SEQ ID NO. 8809), a *Galdieria suilphuraria* asparagine synthetase (SEQ ID NO. 8810), and a maize (*Zea mays*) asparagine synthetase (SEQ ID NO. 8811). These vectors are transformed into maize, and yield and protein quality are evaluated in the resulting transgenic maize plants under limiting and sufficient nitrogen.

(C) Gene suppression under limiting nitrogen utilizing a miRMON18 recognition site sequence. A non-limiting example of this embodiment is a recombinant DNA construct including a transgene transcription unit and an exogenous miRMON18 recognition site, wherein expression of the recombinant DNA construct in a plant results in expression of the transgene when the mature miRMON18 miRNA is not expressed. The 5'UTR of SPX-domain-containing genes of higher plants confers suppression of the mRNA under sufficient nitrogen through regulation by an endogenous mature miRMON18 or miR827. In a non-limiting embodiment of this invention the 5'UTR of an SPX gene regulated by miRMON18 or miR827, such as, but not limited to, AtNLA (SEQ ID NO. 8770), At1g63010 (SEQ ID NO. 8778), Os02g45520 (SEQ ID NO. 8784), Os04g48390 (SEQ ID NO. 8786), and MRT4577_36529C (SEQ ID NO. 8788), is incorporated in the leader sequence of a transgene expression cassette. This results in suppression of the transgene under sufficient nitrogen, regardless of promoter sequence utilized, to eliminate off-types associated with unregulated transgene expression. In a preferred embodiment, the conserved 4-nucleotide sequence AUG(G/U) present at the cleavage site in the miRMON18 or miR827 recognition site is changed to GUGG to prevent unintended initiation while preserving base-pairing to the mature miRNA. Alternatively, synthetic miRMON18 or miR827 recognition sites are incorporated into non-translated regions, or within the coding region without changing the protein function, to confer suppression under sufficient nitrogen.

In another example, the 5' UTR of Os04g48390 (SEQ ID NO. 8786) is fused to GUS driven by a constitutive promoter; one version containing the endogenous rice sequence with AUG present at the miRMON18 cleavage site, and another version wherein the AUG at the miRMON18 cleavage site has been modified to GUG are constructed. A third construct, with tandem (two or more) synthetic miRMON18 recognition sites introduced into the 3' UTR is also evaluated. These vectors are evaluated in transformed maize plants grown under varying nutrient (nitrogen or phosphate) conditions and various tissues assayed for GUS expression.

Figure 16:
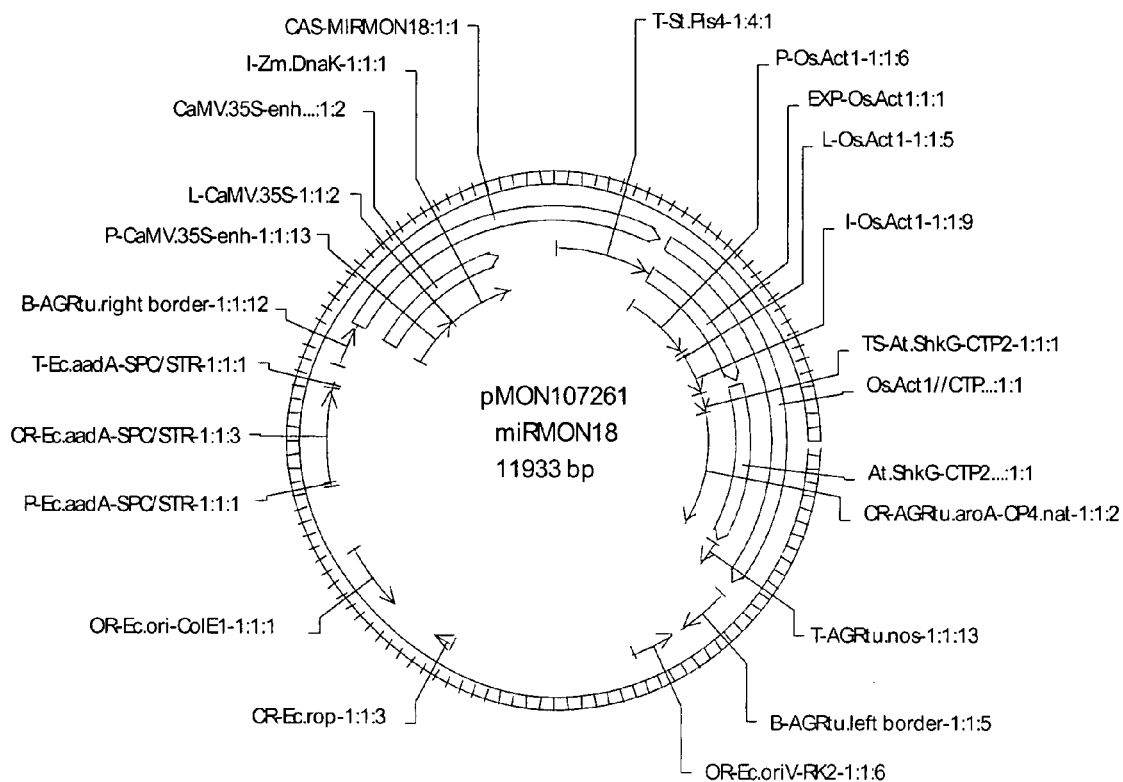
FIG. 16 depicts the vector pMON107261, which includes a CaMV 35S promoter driving expression of the maize miRMON18 transcript (e.g., nucleotides 2173-2788 of SEQ ID NO. 8800), as described in Example 10.

(D) Ectopic expression of MIRMON18 to limit SPX gene expression. In this embodiment, miRMON18 (or in *Arabidopsis*, miR827) expression is driven by a constitutive or tissue-specific promoter, resulting in suppression of all miRMON18-regulated (or miR827-regulated) genes such as the conserved SPX genes. One non-limiting example includes the vector pMON107261 (FIG. 16), which includes a CaMV 35S promoter driving expression of the maize miRMON18 transcript (e.g., nucleotides 2173-2788 of SEQ ID NO. 8800). Phenotypes of transgenic maize and *Arabidopsis* plants transformed with this vector are evaluated and plants exhibiting improved traits such as increased yield under nitrogen- or phosphate-limited conditions are selected.

Example 11

This example describes a recombinant DNA construct that is transcribed to an RNA transcript including at least one miRNA decoy sequence that is recognized and bound by an endogenous mature miRNA but not cleaved. In one preferred embodiment of this invention, the endogenous mature miRNA is one that is responsive to nutrient stress—e.g., a mature miRNA with expression that is either upregulated or downregulated by conditions of nutrient deficiency, relative to expression under nutrient sufficiency. More specifically, this example describes miRNA decoy sequences for mature miRNAs (miR827, miRMON18, and miR399) that are responsive to nutrient stress.

Examples 6-10 describe two miRNAs, miR827 (SEQ ID NO. 8744) and miRMON18 (SEQ ID NO. 393, SEQ ID NO. 3227, or SEQ ID NO. 8742) that exhibit an expression pattern characterized by regulation of the miRNA by nutrient stress (for example, suppression of the miRNA under conditions of nitrogen deficiency, phosphate deficiency, or both nitrogen and phosphate deficiency). Another miRNA, miR399, identified in *Arabidopsis thaliana*, has the sequence UGCCAAAGGAGAGUUGCCCUG (SEQ ID NO. 8812); an identical miRNA was identified by small RNA sequencing in maize (SEQ ID NO. 8813) rice (SEQ ID NO. 8814), and soybean (SEQ ID NO. 8815).

The maize miR399 gene was found to be responsive to nitrogen availability. Maize miR399 precursors were identified from proprietary cDNA datasets and included a Zm-miR399 cDNA sequence (MRT4577_22484C.8) having the sequence of SEQ ID NO. 8816, which contained a Zm-miR399 precursor (SEQ ID NO. 8817) at nucleotides 71-175 of SEQ ID NO. 8816, and another Zm-miR399 cDNA sequence (MRT4577_22487C.6) having the sequence of SEQ ID NO. 8818, which contained a Zm-miR399 precursor (SEQ ID NO. 8819) at nucleotides 136-330 of SEQ ID NO. 8818. The fold-back structures of the maize miR399 precursors are depicted in FIG. 17A; FIG. 17B depicts results of transcriptional profiling experiments with probe A1ZM033468_at corresponding to MRT4577_22487C.6 (SEQ ID NO. 8818), which demonstrate that the Zm-miR399 pri-miRNA (SEQ ID NO. 8817) is suppressed under nitrogen-deficient conditions (black bars) and is expressed under nitrogen-sufficient conditions (white bars).

In *Arabidopsis thaliana*, miR399 has been reported to be responsive to inorganic phosphate availability and to suppress a clade of genes including the *Arabidopsis thaliana* PHO2 gene (At2g33770, encoding an E2 conjugase) and putative PHO2 orthologues from various plants. Inorganic phosphate deprivation induces expression of miR399; overexpression of miR399 in phosphate-replete conditions represses PHO2 expression and leads to high leaf phosphate concentrations. See Fujii et al. (2005) *Curr. Biol.*, 15: 2038-2043; Chiou et al. (2006) *Plant Cell*, 18:412-421; Aung et al. (2006) *Plant Physiol.* 141:1000-1011; and Bari et al. (2006) *Plant Physiol.*, 141:988-999.

A conserved 23-nucleotide motif found in the *Arabidopsis thaliana* IPS1 transcript and other members of the Mt4-TPS1 family of genes was reported to have a sequence complementary to miR399 except for a mismatched loop corresponding to positions 10 and 11 in the mature miR399, which prevents cleavage of the miR399:IPS1 duplex; see Franco-Zorrilla et al. (2007) *Nature Genetics*, 39:1033-1037. A similar non-cleavable sequence that also contains mismatches corresponding to positions 10 and 11 in the mature miRNA has been reported for miR390; see Axtell et al. (2006) *Cell*, 127: 565-577.

Rules were developed for predicting an endogenous "microRNA decoy sequence", i.e., a sequence that can be recognized and bound by an endogenous mature miRNA resulting in base-pairing between the miRNA decoy sequence and the endogenous mature miRNA, thereby forming a cleavage-resistant RNA duplex that is not cleaved because of the presence of mismatches between the miRNA decoy sequence and the mature miRNA. In general, these rules define (1) mismatches that are required, and (2) mismatches that are permitted but not required. Mismatches include canonical mismatches (e.g., G-A, C-U, C-A) as well as G::U wobble pairs and indels (nucleotide insertions or deletions).

Required mismatches include: (a) at least 1 mismatch between the miRNA decoy sequence and the endogenous mature miRNA at positions 9, 10, or 11 of the endogenous mature miRNA, or alternatively, (b) 1, 2, 3, 4, or 5 insertions (i.e., extra nucleotides) at a position in the miRNA decoy sequence corresponding to positions 9, 10, or 11 of the endogenous mature miRNA. In preferred embodiments, there exists either (a) at least 1 mismatch between the miRNA decoy sequence and the endogenous mature miRNA at positions 10 and/or 11 of the endogenous mature miRNA, or (b) at least 1 insertion at a position in the miRNA decoy sequence corresponding to position 10 and/or 11 of the endogenous mature miRNA.

Mismatches that are permitted, but not required, include: (a) 0, 1, or 2 mismatches between the miRNA decoy sequence and the endogenous mature miRNA at positions 1, 2, 3, 4, 5, 6, 7, 8, and 9 of the endogenous mature miRNA, and (b) 0, 1, 2, or 3 mismatches between the miRNA decoy sequence and the endogenous mature miRNA at positions 12 through the last position of the endogenous mature miRNA (i.e., at position 21 of a 21-nucleotide mature miRNA), wherein each of the mismatches at positions 12 through the last position of the endogenous mature miRNA is adjacent to at least one complementary base-pair (i.e., so that there is not more than 2 contiguous mismatches at positions 12 through the last position of the endogenous mature miRNA). In preferred embodiments, there exist no mismatches (i.e., there are all complementary base-pairs) at positions 1, 2, 3, 4, 5, 6, 7, and 8 of the endogenous mature miRNA.

These rules were employed to identify from proprietary cDNA datasets a number of maize sequences or soybean sequences containing endogenous miRNA decoy sequences. Table 8 provides maize (*Zea mays*) endogenous miRNA decoy sequences for miRMON18 (SEQ ID NO. 393, SEQ ID NO. 3227, or SEQ ID NO. 8742); mismatches in the miRNA decoy sequence are indicated by underlined text in the alignment between the miRNA and the miRNA decoy sequence.

TABLE 8

| SEQ ID NO. | rmRMON18 decoy sequence | maize cDNA identifier and SEQ ID NO. (nucleotide position of encoded miRNA decoy sequence in cDNA) | Alignment between miRMON18 given in 3' to 5' direction (above) and miRNA decoy sequence given in 5' to 3' direction (below) |
|---|---|---|---|
| 8820 | AGGUUGCUGAUGAAGUCAUCUAA | MRT4577_321885C.1 (SEQ ID NO. 8821) (182-204) | ACAAACGACUAC--CAGUAGAUU<br>AGGUUGCUGAUGAAGUCAUCUAA |
| 8822 | UCUUUGCAGAGUGUCAUCUAA | MRT4577_531852C.2 (SEQ ID NO. 8823) (198-218) | ACAAACGACUACCAGUAGAUU<br>UCUUUGCAGAGUGUCAUCUAA |
| 8824 | UGUUUGAUAGAGAUCAUCUAA | MRT4577_606578C.1 (SEQ ID NO. 8825) (65-85) | ACAAACGACUACCAGUAGAUU<br>UGUUUGAUAGAGAUCAUCUAA |

Table 9 provides maize (*Zea mays*) endogenous miRNA decoy sequences for miR399 (SEQ ID NO. 8812, SEQ ID NO. 8813, SEQ ID NO. 8814, or SEQ ID NO. 8815); mismatches in the miRNA decoy sequence are indicated by underlined text in the alignment between the miRNA and the miRNA decoy sequence.

TABLE 9

| SEQ ID NO. | miR399 decoy sequence | maize cDNA identifier and SEQ ID NO. (nucleotide position of encoded miRNA decoy sequence in cDNA) | Alignment between miR300 given in 3' to 5' direction (above) and miRNA decoy sequence given in 5' to 3' direction (below) |
|---|---|---|---|
| 8826 | UAGGGCAACUUGUAUCCUUUGGCA | MRT4577_47862C.7 (SEQ ID NO. 8827) (699-722) | GUCCCGUUGAG---AGGAAACCGU<br>UAGGGCAACUUGUAUCCUUUGGCA |
| 8828 | CAGGGCAAGUUGAAUCCUUUGGCA | MRT4577_36567C.8 (SEQ ID NO. 8829) (746-769) | GUCCCGUUGAG---AGGAAACCGU<br>CAGGGCAAGUUGAAUCCUUUGGCA |
| 8830 | UAGGGCAACUUGUAUCCUUUGGCA | MRT4577_521786C.1 (SEQ ID NO. 8831) (156-179) | GUCCCGUUGAG---AGGAAACCGU<br>UAGGGCAACUUGUAUCCUUUGGCA |
| 8832 | UAGGGCACCUUGUCUCCUUUGGCA | MRT4577_135578C.1 (SEQ ID NO. 8833) (185-208) | GUCCCGUUGU---GAGGAAACCGU<br>UAGGGCACCUUGUCUCCUUUGGCA |

Figure 18:
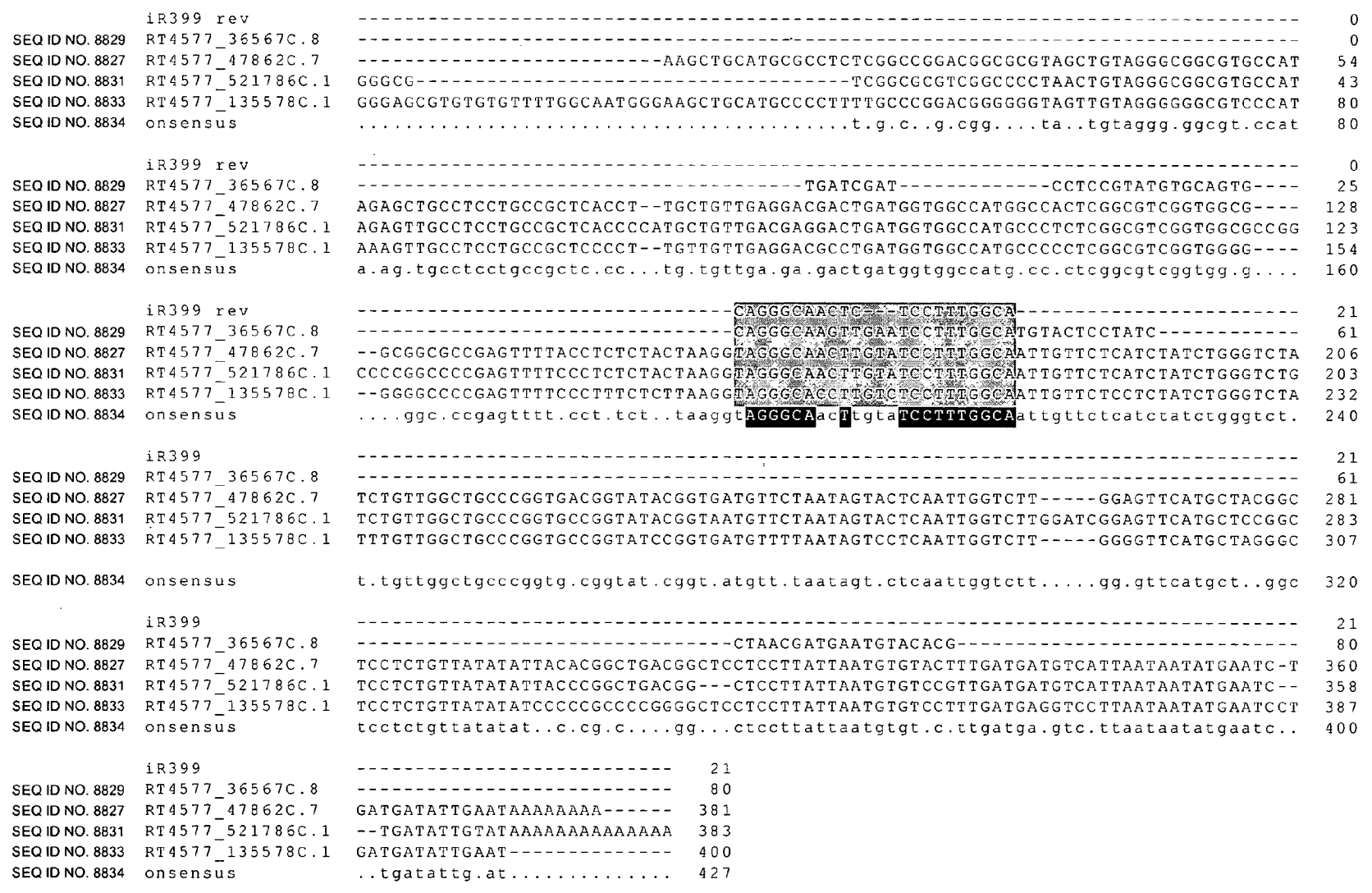

MicroRNA miR399 decoy sequences were identified in the minus strand of two cDNA sequences (SEQ ID NO. 8831 and SEQ ID NO. 8833). A six-frame translation analysis of the cDNA sequences provided in Table 9 did not reveal any long open reading frames, and BLAST searches of these same sequences did not identify any protein in public databases, indicating that these genes are likely non-coding sequences. Alignment of the maize cDNA sequences of the miR399 decoy sequences is depicted in FIG. 18 with the consensus sequence given as SEQ ID NO. 8834, and reveals at least two groups of genes containing miR399 decoy sequences: the first group contains closely related genes MRT4577_47862C.7 (SEQ ID NO. 8827), MRT4577_521786C.1 (SEQ ID NO. 8831), and MRT4577_135578C.1 (SEQ ID NO. 8833), and the second group contains MRT4577_36567C.8 (SEQ ID NO. 8829). There was only a 1-nucleotide difference between the miRNA decoy sequence in the first group of maize genes containing a miR399 decoy sequence (SEQ ID NO. 8827, SEQ ID NO. 8831, and SEQ ID NO. 8833) and the *Arabidopsis thaliana* IPS1 (AT3G09922.1) miR399 "mimic" site reported by Franco-Zorrilla et al. (2007) *Nature Genetics,* 39:1033-1037; the conserved G at position 12 of SEQ ID NO. 8826, SEQ ID NO. 8830, and SEQ ID NO. 8832 is replaced by a C in the *Arabidopsis* miR399 "mimic" site. However, homology between the maize genes (SEQ ID NO. 8827, SEQ ID NO. 8831, and SEQ ID NO. 8833) and the *Arabidopsis thaliana* IPS1 (AT3G09922.1) gene was limited to the miRNA decoy sequence site.

Table 10 provides soybean (*Glycine max*) endogenous miRNA decoy sequences for miR399 (SEQ ID NO. 8812, SEQ ID NO. 8813, SEQ ID NO. 8814, or SEQ ID NO. 8815); mismatches in the miRNA decoy sequence are indicated by underlined text in the alignment between the miRNA and the miRNA decoy sequence. Transcription profiling data was used to compare expression of endogenous miRNA decoy cDNA sequences and the corresponding miRNA precursors; the probeset included A1GM035741_at (corresponding to SEQ ID NO. 8836), A1GM069937_at (corresponding to SEQ ID NO. 8838), A1GM074873_at (corresponding to SEQ ID NO. 8840), A1GM031412_at (corresponding to SEQ ID NO. 8842), and A1GM053788_at (corresponding to SEQ ID NO. 8844).

TABLE 10

| SEQ ID NO. | miR399 decoy sequence | maize cDNA identifier and SEQ ID NO. (nucleotide position of encoded miRNA decoy sequence in cDNA) | Alignment between miR399 given in 3' to 5' direction (above) and miRNA decoy sequence given in 5' to 3' direction (below) |
|---|---|---|---|
| 8835 | UAGGGCAACUUCGAUCCUUUGGCA | MRT3847_238967C.1 (SEQ ID NO. 8836) (390-413) | GUCCCGUUAAG---AGGAAACCGU<br>uagggcaacuucgauccuuuggca |
| 8837 | UAGGGCAACUUCUAUCCUUUGGCA | MRT3847_241832C.1 (SEQ ID NO. 8838) (393-416) | GUCCCGUUAAG---AGGAAACCGU<br>uagggcaacuucuauccuuuggca |
| 8839 | AAGGGCAACUUCAAUCCUUUGGCA | MRT3847_336885C.1 (SEQ ID NO. 8840) (96-119) | GUCCCGUUAAG---AGGAAACCCU<br>aagggcaacuucaauccuuuggca |
| 8841 | AAGGGCAACUUCCAUCCUUUGGCA | MRT3847_217257C.2 (SEQ ID NO. 8842) (179-202) | CUCCCGUUAAG---AGGAAACCGU<br>aagggcaacuuccauccuuuggca |
| 8843 | AAGGGCAACUUCCAUCCUUUGGCA | MRT3847_236871C.3 (SEQ ID NO. 8844) (238-261) | GUCCCGUUAAG---AGGAAACCGU<br>aagggcaacuuccauccuuuggca |

Transcription profiling experiments were used to compare expression of maize endogenous miR399 decoy cDNA sequences and the corresponding maize miR399 precursors under different nitrogen conditions. Group 1 miR399 decoy gene MRT4577_47862C.7 (SEQ ID NO. 8827) exhibited about a two-fold down-regulation under nitrogen-deficient conditions in maize leaf (FIG. 19A); group 2 miR399 decoy gene MRT4577_36567C.8 (SEQ ID NO. 8829) exhibited an even more dramatic down-regulation of at least ten-fold or greater under nitrogen-deficient conditions in maize leaf (FIG. 19B). These results were verified by northern blots measuring expression of the mature miR399 (FIG. 19C) and of the miR399 decoy sequence MRT4577_47862C.7 (SEQ ID NO. 8827) (FIG. 19D). The northern blots were made with 5 micrograms per lane of total RNA from V6 leaf from maize grown under low (2 millimolar) or high (20 millimolar) nitrogen, and the same blot probed for the mature 21-nucleotide miR399 (FIG. 19C) and the miR399 decoy sequence MRT4577_47862C.7 (SEQ ID NO. 8827) (FIG. 19D, with major band at about 600 bp). Higher expression levels of the maize miR399 decoy sequences during nitrogen sufficiency mirror the higher expression levels of the maize miR399 precursors during nitrogen sufficiency (FIG. 17B).

Similar transcription profiling experiments were used to compare expression of maize endogenous miR399 decoy cDNA sequences and the corresponding maize miR399 precursors under different temperature conditions. Group 2 miR399 decoy gene MRT4577_36567C.8 (SEQ ID NO. 8829) exhibited at least ten-fold or greater higher expression during nitrogen-sufficient conditions in maize leaf, especially during daylight hours (FIG. 20A). This same gene exhibited at least a two-fold down-regulation in root (FIG. 20B) and in shoot (FIG. 20C) after extended exposure to cold.

The expression of the endogenous miR399 decoy cDNA sequences were also compared in different tissues in both maize and soybean. FIG. 21A depicts expression levels of the group 1 maize miR399 decoy sequence SEQ ID NO. 8827 (MRT4577_47862C, represented by probes A1ZM005814_at and A1ZM005813_s_at), and the group 2 maize miR399 decoy sequence SEQ ID NO. 8829 (MRT4577_36567C, represented by probe A1ZM048024_at), as well as of the maize pri-miR399 sequence SEQ ID NO. 8818 (MRT4577_22487C.6 represented by probe A1ZM033468_at). FIG. 21B depicts expression levels of the soybean miR399 decoy sequences SEQ ID NO. 8842 (MRT3847_217257C.2, represented by probe A1GM031412_at), SEQ ID NO. 8844 (MRT4577_236871C.2, represented by probe A1GM053788_at), SEQ ID NO. 8836 (MRT3847_238967C.1, represented by probe A1GM035741_at), and SEQ ID NO. 8838 (MRT3847_241832C.1, represented by probe A1GM069937_at).

These data confirm a novel nitrogen-responsive expression pattern in crop plants including maize and soybean for both the mature miR399 (and the miR399 precursors) as well as for the endogenous miR399 decoy sequences. Various utilities of the miR399 include overexpression of the mature miR399 (e.g., by overexpression of a pri-miR399 sequence), expression of an engineered miR399 designed to suppress a gene other than one natively targetted by a native mature miR399, expression of a transgene (coding or non-coding sequence or both) under control of the miR399 promoter, expression of a transgene in which a miR399 recognition site has been added or removed, overexpression of a miR399 decoy sequence, and suppression of an endogenous miR399 decoy sequence.

Table 11 provides soybean (*Glycine max*) and maize (*Zea mays*) endogenous miRNA decoy sequences for miR319, UUGGACUGAAAGGAGCUCCU (SEQ ID NO. 8845), which has been identified in a number of plant species including *Arabidopsis thaliana, Oryza sativa, Zea mays*, and *Glycine max* (see publicly available examples at miRBase, microrna.sanger.ac.uk/cgi-bin/sequences/query.pl?terms=miR319); mismatches in the miRNA decoy sequence are indicated by underlined text in the alignment between the miRNA and the miRNA decoy sequence. FIG. 22A depicts transcription profiling data in various soybean tissues of the soybean endogenous miR319 decoy SEQ ID NO. 8847 (MRT3847_41831C.6, represented by probe A1GM001017_at); FIG. 22B depicts transcription profiling data in various maize tissues of the maize endogenous miR319 decoy SEQ ID NO. 8849 (MRT4577_577703C.1, represented by probe A1ZM012886_s_at).

TABLE 11

| SEQ ID NO. | miR319 decoy sequence | cDNA identifier and SEQ ID NO. (nucleotide position of encoded miRNA decoy sequence in cDNA) | Alignment between miR319 given in 3' to 5' direction (above) and miRNA decoy sequence given in 5' to 3' direction (below) |
|---|---|---|---|
| 846 | GGGAGUUUCUACCUCCAGUCCAA | MRT3847_41831C.6 (SEQ ID NO. 8847) (545-567) | UCCUCGAGGA---AAGUCAGGUU gggaguuucuaccuccaguccaa |
| 8848 | GGGAGCGCCAAUCAGUCCAA | MRT4577_577703G.1 (SEQ ID NO. 8849) (751-770) | UCCUCGAGGAAAGUCAGGUU gggagcgccaaucaguccaa |

Among the target genes regulated by miR319 are the TCP genes involved in leaf development and MYB genes involved in flower development. One embodiment of this invention is altering a plant's leaf or floral architecture or developmental pattern by suppressing transcription of an endogenous mature miR319 in a transgenic plant, or to alter endogenous miR319 activity by overexpressing a miR319 decoy sequence in a transgenic plant.

In yet another example, miR398b (SEQ ID NO. 8850) has been shown to regulate expression of CSD1 and CSD2 (copper/zinc superoxide dismutase); see Sunkar et al. (2006) *Plant Cell*, 18:2051-65. Superoxide dismutase aids in the scavenging of reactive oxygen species (ROS) by converting $O_2$ to $H_2O_2$ and minimizes potential damage caused by superoxide or by superoxide-derived ROS. miR398 is slightly down regulated by oxidative stress and strongly downregulated by Cu availability; see Yamasaki et al. (2007) *J. Biol. Chem.*, 282:16369-16378. One embodiment of this invention includes expressing an chimeric transcript including miR398b decoy sequences (e.g., SEQ ID NOS. 851-8852) under the control of an oxidative stress-inducible promoter, resulting in further suppression of the activity of miR398b and increased CSD1 and CSD2 accumulation and stress protection under stress conditions.

All of the materials and methods disclosed and claimed herein can be made and used without undue experimentation as instructed by the above disclosure. Although the materials and methods of this invention have been described in terms of preferred embodiments and illustrative examples, it will be apparent to those of skill in the art that variations can be applied to the materials and methods described herein without departing from the concept, spirit and scope of the invention. All such similar substitutes and modifications apparent to those skilled in the art are deemed to be within the spirit, scope and concept of the invention as defined by the appended claims.

SEQUENCE LISTING (8852 sequences)

SEQ ID NO: 1 - RNA, 21 nt, Zea mays
uggagaagcagggcacgugca

SEQ ID NO: 2 - RNA, 21 nt, Zea mays
uuuggauugaagggagcucug

SEQ ID NO: 3 - RNA, 21 nt, Zea mays
aagcucaggagggauagcgcc

SEQ ID NO: 4 - RNA, 21 nt, Zea mays
uccacaggcuuucuugaacug

SEQ ID NO: 5 - RNA, 21 nt, Zea mays
uuccacagcuuucuugaacug

SEQ ID NO: 6 - RNA, 21 nt, Zea mays
ugauugagccgugccaauauc

SEQ ID NO: 7 - RNA, 21 nt, Zea mays
agaaucuugaugaugcugcau

SEQ ID NO: 8 - RNA, 21 nt, Zea mays
ucagugcaaucccuuuggaau

SEQ ID NO: 9 - RNA, 22 nt, Zea mays
ugaagcugccagcaugaucugg

SEQ ID NO: 10 - RNA, 21 nt, Zea mays
uggaaggggcaugcagaggag

SEQ ID NO: 11 - RNA, 21 nt, Zea mays
uugagcgcagcguugaugagc

SEQ ID NO: 12 - RNA, 21 nt, Zea mays
ugccaaaggagaguugcccug

SEQ ID NO: 13 - RNA, 21 nt, Zea mays
ugccuggcucccuguaugcca

SEQ ID NO: 14 - RNA, 21 nt, Zea mays
ugaagcugccagcaugaucug

SEQ ID NO: 15 - RNA, 21 nt, Zea mays
ucggaccaggcuucauucccc

SEQ ID NO: 16 - RNA, 19 nt, Zea mays
uguguucucaggucgcccc

SEQ ID NO: 17 - RNA, 24 nt, Zea mays
uaugcgucuugucgauaguugcgg

SEQ ID NO: 18 - RNA, 24 nt, Zea mays
uccguuguagucuagcuggucagg

SEQ ID NO: 19 - RNA, 21 nt, Zea mays
uucuagggacuaauguuuagu

SEQ ID NO: 20 - RNA, 22 nt, Zea mays
ugcugcaagcuuuaugguucga

SEQ ID NO: 21 - RNA, 21 nt, Zea mays
ugcuaaaagugaagugcuaaa

SEQ ID NO: 22 - RNA, 21 nt, Zea mays
uggagaagcaggacacgugag

SEQ ID NO: 23 - RNA, 20 nt, Zea mays
uuggcauucuguccaccucc

SEQ ID NO: 24 - RNA, 21 nt, Zea mays
ucauggauugucauaaucuag

SEQ ID NO: 25 - RNA, 21 nt, Zea mays
ucaauccggacgccgaugugg

SEQ ID NO: 26 - RNA, 21 nt, Zea mays
cccgccggcgagcgcuuuccu

SEQ ID NO: 27 - RNA, 20 nt, Zea mays
ggggauguaguucagauggu

SEQ ID NO: 28 - RNA, 21 nt, Zea mays
ugccaaaggagaauugcccug

SEQ ID NO: 29 - RNA, 19 nt, Zea mays
gucugggugguguaguugg

SEQ ID NO: 30 - RNA, 22 nt, Zea mays
cggaugggugcugcgcgguggu

SEQ ID NO: 31 - RNA, 21 nt, Zea mays
ugccaaaggagagcuguccug

SEQ ID NO: 32 - RNA, 21 nt, Zea mays
ugauugagccgcgccaauauc

SEQ ID NO: 33 - RNA, 21 nt, Zea mays
ugaucaauggccacacaaccc

SEQ ID NO: 34 - RNA, 21 nt, Zea mays
ugauaggccgaacuguggagu

SEQ ID NO: 35 - RNA, 21 nt, Zea mays
ucaagaacaaguaccacagga

SEQ ID NO: 36 - RNA, 21 nt, Zea mays
uaccauauugaguugcaugca

SEQ ID NO: 37 - RNA, 20 nt, Zea mays
uguaaccgaacaaggccuaa

SEQ ID NO: 38 - RNA, 21 nt, Zea mays
uacacguuaggaugaugcaca

SEQ ID NO: 39 - RNA, 21 nt, Zea mays
ugcgucuggaucgaaggagau

SEQ ID NO: 40 - RNA, 21 nt, Zea mays
ucccuugggaaaaugagguuc

SEQ ID NO: 41 - RNA, 21 nt, Zea mays
uucaaguugcacuggugcaaa

SEQ ID NO: 42 - RNA, 21 nt, Zea mays
uuagauacaaauuguggucca

SEQ ID NO: 43 - RNA, 21 nt, Zea mays
uccaauuccaugugcaccaaa

SEQ ID NO: 44 - RNA, 21 nt, Zea mays
uuggaggugcuacucggaagu

SEQ ID NO: 45 - RNA, 21 nt, Zea mays
ucuaaagguccaggaggcucg

SEQ ID NO: 46 - RNA, 21 nt, Zea mays
ugggcccuguacaugugaugg

SEQ ID NO: 47 - RNA, 21 nt, Zea mays
ugaagaacuaaccuuaggcag

SEQ ID NO: 48 - RNA, 21 nt, Zea mays
uuagugcauucaaacaucccc

SEQ ID NO: 49 - RNA, 21 nt, Zea mays
ugggaauaaccgaacaaggcc

SEQ ID NO: 50 - RNA, 20 nt, Zea mays
ucguuggcgggcgcgacugg

SEQ ID NO: 51 - RNA, 21 nt, Zea mays
ugugagcucacccuugcgaua

SEQ ID NO: 52 - RNA, 21 nt, Zea mays
uccccuccgauccuccuggga

SEQ ID NO: 53 - RNA, 21 nt, Zea mays
ugguugaacuuguguuguuga

SEQ ID NO: 54 - RNA, 21 nt, Zea mays
ugcacagaaggacugcuugca

SEQ ID NO: 55 - RNA, 21 nt, Zea mays
uggcacgacaaaaaacucgca

SEQ ID NO: 56 - RNA, 20 nt, Zea mays
uguuaccucggcgccacagg

SEQ ID NO: 57 - RNA, 21 nt, Zea mays
uugugaggggcugcaaacagc

SEQ ID NO: 58 - RNA, 21 nt, Zea mays
ucuaauggaccagaugguuug

SEQ ID NO: 59 - RNA, 21 nt, Zea mays
ugcacuguauacgcguagggg

SEQ ID NO: 60 - RNA, 21 nt, Zea mays
ucaacacacguggauugcggu

SEQ ID NO: 61 - RNA, 21 nt, Zea mays
ucugcacaggcgcggacgguc

SEQ ID NO: 62 - RNA, 21 nt, Zea mays
uuccugccuaaggcgccacaa

SEQ ID NO: 63 - RNA, 21 nt, Zea mays
uugcugacauggcgaugguuu

SEQ ID NO: 64 - RNA, 20 nt, Zea mays
ucgguuguuccggauuggag

SEQ ID NO: 65 - RNA, 21 nt, Zea mays
ucgccgugaguugcaacguga

SEQ ID NO: 66 - RNA, 21 nt, Zea mays
ucaacaucauguggcccagau

SEQ ID NO: 67 - RNA, 21 nt, Zea mays
ugaugaaauuagacuagaugc

SEQ ID NO: 68 - RNA, 21 nt, Zea mays
ucaauacacauggauuaaggu

SEQ ID NO: 69 - RNA, 21 nt, Zea mays
uagggcuuguucguuuuggag

SEQ ID NO: 70 - RNA, 21 nt, Zea mays
uagcgaucugaucauugacgg

SEQ ID NO: 71 - RNA, 21 nt, Zea mays
ugguggucguggcugccggcg

SEQ ID NO: 72 - RNA, 21 nt, Zea mays
ugcaacgcacgagcauucacc

SEQ ID NO: 73 - RNA, 21 nt, Zea mays
ugcucgacagggacuugguca

SEQ ID NO: 74 - RNA, 21 nt, Zea mays
uggccucgggcgagucgugac

SEQ ID NO: 75 - RNA, 21 nt, Zea mays
uggcgacgacguacugcagcg

SEQ ID NO: 76 - RNA, 21 nt, Zea mays
uucgguacuguaaacgacaag

SEQ ID NO: 77 - RNA, 20 nt, Zea mays
ugguuccaaacauaccgguu

SEQ ID NO: 78 - RNA, 21 nt, Zea mays
uguuggagcgggguguuuugu

SEQ ID NO: 79 - RNA, 21 nt, Zea mays
ucgacugaggacgauucuugg

SEQ ID NO: 80 - RNA, 20 nt, Zea mays
uggcguguccgcgcugaggg

SEQ ID NO: 81 - RNA, 21 nt, Zea mays
ucucucccgcuaaauggaugg

SEQ ID NO: 82 - RNA, 21 nt, Zea mays
ucacaaagaaccucucacauc

SEQ ID NO: 83 - RNA, 21 nt, Zea mays
ugggagucacaaaacuggaga

SEQ ID NO: 84 - RNA, 21 nt, Zea mays
uuuucggguaaaguccuauaa

SEQ ID NO: 85 - RNA, 21 nt, Zea mays
ucccuaaucaccaaaucagcc

SEQ ID NO: 86 - RNA, 21 nt, Zea mays
uccaagcuccaaaaucaacua

SEQ ID NO: 87 - RNA, 21 nt, Zea mays
uuaguugucgcuggauagugc

SEQ ID NO: 88 - RNA, 21 nt, Zea mays
uaaggagguguuuguuuggaa

SEQ ID NO: 89 - RNA, 21 nt, Zea mays
ugacauguugguguugcuguc

SEQ ID NO: 90 - RNA, 20 nt, Zea mays
ucgguucuucgguucgguuc

SEQ ID NO: 91 - RNA, 21 nt, Zea mays
ugaagucuauccgcaguccaa

SEQ ID NO: 92 - RNA, 21 nt, Zea mays
uggagccaugccaaacaggcc

SEQ ID NO: 93 - RNA, 20 nt, Zea mays
uucucaacacuacacuagga

SEQ ID NO: 94 - RNA, 21 nt, Zea mays
uguuugaaugcacuagagcua

SEQ ID NO: 95 - RNA, 21 nt, Zea mays
ugaggcuuauguccgacggcu

SEQ ID NO: 96 - RNA, 20 nt, Zea mays
ugccaaagaaaaaccaucca

SEQ ID NO: 97 - RNA, 20 nt, Zea mays
ugugcaugcagaugugugac

SEQ ID NO: 98 - RNA, 21 nt, Zea mays
ugggugauuguauuucuggua

SEQ ID NO: 99 - RNA, 21 nt, Zea mays
uagguuuguacacauagcgcg

SEQ ID NO: 100 - RNA, 21 nt, Zea mays
uaagaaaaccgccacuagaaa

SEQ ID NO: 101 - RNA, 21 nt, Zea mays
ucgcggcugguacgcgggucc

SEQ ID NO: 102 - RNA, 21 nt, Zea mays
ugaucgguuguuagugcucga

SEQ ID NO: 103 - RNA, 21 nt, Zea mays
uaaauauuagucacuagaaac

SEQ ID NO: 104 - RNA, 21 nt, Zea mays
uugguccguuagaucuagauc

SEQ ID NO: 105 - RNA, 21 nt, Zea mays
uggugcaagugugcaaucaaa

SEQ ID NO: 106 - RNA, 21 nt, Zea mays
uaccgucgaacuuaaugggca

SEQ ID NO: 107 - RNA, 20 nt, Zea mays
ucaauacauguggauugagg

SEQ ID NO: 108 - RNA, 21 nt, Zea mays
ucucugccugucucgucugcc

SEQ ID NO: 109 - RNA, 21 nt, Zea mays
ucaugucgccaccgccgcucc

SEQ ID NO: 110 - RNA, 21 nt, Zea mays
ucccccucuggauugguguaa

SEQ ID NO: 111 - RNA, 21 nt, Zea mays
uaaagaagcaaacaugaugac

SEQ ID NO: 112 - RNA, 20 nt, Zea mays
uucaugugcauuagauaugu

SEQ ID NO: 113 - RNA, 21 nt, Zea mays
uggaacugcacuaucacuaua

SEQ ID NO: 114 - RNA, 21 nt, Zea mays
ucuaauggaucagaugguuug

SEQ ID NO: 115 - RNA, 21 nt, Zea mays
ucacgcacggggcuugcuguc

SEQ ID NO: 116 - RNA, 21 nt, Zea mays
uauagugcauucaaacacccc

SEQ ID NO: 117 - RNA, 21 nt, Zea mays
uggagaagcagggcacgugca

SEQ ID NO: 118 - RNA, 21 nt, Zea mays
uuuggauugaagggagcucug

SEQ ID NO: 119 - RNA, 21 nt, Zea mays
aagcucaggagggauagcgcc

SEQ ID NO: 120 - RNA, 21 nt, Zea mays
uccacaggcuuucuugaacug

SEQ ID NO: 121 - RNA, 21 nt, Zea mays
uuccacagcuuucuugaacug

SEQ ID NO: 122 - RNA, 20 nt, Zea mays
ggccuauuagcucaguuggu

SEQ ID NO: 123 - RNA, 21 nt, Zea mays
ugauugagccgugccaauauc

SEQ ID NO: 124 - RNA, 21 nt, Zea mays
agaaucuugaugaugcugcau

SEQ ID NO: 125 - RNA, 21 nt, Zea mays
ucagugcaaucccuuuggaau

SEQ ID NO: 126 - RNA, 22 nt, Zea mays
ugaagcugccagcaugaucugg

SEQ ID NO: 127 - RNA, 21 nt, Zea mays
uggaaggggcaugcagaggag

SEQ ID NO: 128 - RNA, 21 nt, Zea mays
uugagcgcagcguugaugagc

SEQ ID NO: 129 - RNA, 21 nt, Zea mays
ugccaaaggagaguugcccug

SEQ ID NO: 130 - RNA, 21 nt, Zea mays
uagccaaggaugacuugccua

SEQ ID NO: 131 - RNA, 21 nt, Zea mays
ugaagcugccagcaugaucug

SEQ ID NO: 132 - RNA, 21 nt, Zea mays
ucggaccaggcuucauucccc

SEQ ID NO: 133 - RNA, 21 nt, Zea mays
uuccacagcuuucuugaacuu

SEQ ID NO: 134 - RNA, 19 nt, Zea mays
uguguucucaggucgcccc

SEQ ID NO: 135 - RNA, 21 nt, Zea mays
uggccgaccaaauucgaggac

SEQ ID NO: 136 - RNA, 23 nt, Zea mays
ggggauguaguucagaugguaga

SEQ ID NO: 137 - RNA, 21 nt, Zea mays
ugagugcugaugauuuaauau

SEQ ID NO: 138 - RNA, 21 nt, Zea mays
uggagaagcaggacacgugag

SEQ ID NO: 139 - RNA, 20 nt, Zea mays
ugagccgaaccaauaucacu

SEQ ID NO: 140 - RNA, 20 nt, Zea mays
uuggcauucuguccaccucc

SEQ ID NO: 141 - RNA, 21 nt, Zea mays
uucgauccccggcaacggcgc

SEQ ID NO: 142 - RNA, 21 nt, Zea mays
uccccuucaauucccucuggu

SEQ ID NO: 143 - RNA, 21 nt, Zea mays
ugccaaaggagaauugcccug

SEQ ID NO: 144 - RNA, 21 nt, Zea mays
uauccagauguguugaggugg

SEQ ID NO: 145 - RNA, 21 nt, Zea mays
uccauguggauugagugggau

SEQ ID NO: 146 - RNA, 22 nt, Zea mays
cggaugggugcugcgcgguggu

SEQ ID NO: 147 - RNA, 21 nt, Zea mays
ugguucguggcuaacugugcc

SEQ ID NO: 148 - RNA, 21 nt, Zea mays
ugccaaaggagagcuguccug

SEQ ID NO: 149 - RNA, 22 nt, Zea mays
uagccagggaugauuugccugu

SEQ ID NO: 150 - RNA, 24 nt, Zea mays
agucaaacgcuugaugugacccgg

SEQ ID NO: 151 - RNA, 21 nt, Zea mays
ugcacgcuugcacagaaggac

SEQ ID NO: 152 - RNA, 21 nt, Zea mays
ucacuauaggucuauagcagu

SEQ ID NO: 153 - RNA, 21 nt, Zea mays
ucccuugggaaaaugagguuc

SEQ ID NO: 154 - RNA, 21 nt, Zea mays
uacggaguuauacguauugau

SEQ ID NO: 155 - RNA, 21 nt, Zea mays
ucugaagagcaaguugguacc

SEQ ID NO: 156 - RNA, 21 nt, Zea mays
ucguuaagcuaacgagcuggc

SEQ ID NO: 157 - RNA, 20 nt, Zea mays
uuuggugaccagggaucacg

SEQ ID NO: 158 - RNA, 21 nt, Zea mays
ugcccacucaaauuuucgcaa

SEQ ID NO: 159 - RNA, 20 nt, Zea mays
ugcaccaaauaagugauugc

SEQ ID NO: 160 - RNA, 21 nt, Zea mays
ucaacggugucauauauuuaa

SEQ ID NO: 161 - RNA, 21 nt, Zea mays
ugcaccaggauaagugauugc

SEQ ID NO: 162 - RNA, 20 nt, Zea mays
uggcggggagcguccgagag

SEQ ID NO: 163 - RNA, 21 nt, Zea mays
ugguggcgcuguggcugugcu

SEQ ID NO: 164 - RNA, 21 nt, Zea mays
uaaaucuggugcauccaucuu

SEQ ID NO: 165 - RNA, 21 nt, Zea mays
uuugugaggggcugcaaacag

SEQ ID NO: 166 - RNA, 21 nt, Zea mays
uauuugggauaauaaucugcc

SEQ ID NO: 167 - RNA, 20 nt, Zea mays
uucagcaaagaagucuggag

SEQ ID NO: 168 - RNA, 20 nt, Zea mays
uagauuaacuuggcuuaaua

SEQ ID NO: 169 - RNA, 21 nt, Zea mays
ugauuaaacaggugauggcau

SEQ ID NO: 170 - RNA, 21 nt, Zea mays
ugcaaucacucauuuggugca

SEQ ID NO: 171 - RNA, 21 nt, Zea mays
uauagggacccgaaaugugca

SEQ ID NO: 172 - RNA, 21 nt, Zea mays
uaagcuggaauaauucgggcg

SEQ ID NO: 173 - RNA, 21 nt, Zea mays
uuuugaggcugauguuuggcg

SEQ ID NO: 174 - RNA, 21 nt, Zea mays
uagaucuaaaaugagugguga

SEQ ID NO: 175 - RNA, 21 nt, Zea mays
uagguuaaagauauacaugga

SEQ ID NO: 176 - RNA, 20 nt, Zea mays
uuuuauuagucgcuggauag

SEQ ID NO: 177 - RNA, 21 nt, Zea mays
uauggacgagucugguguggu

SEQ ID NO: 178 - RNA, 21 nt, Zea mays
uaauuuagggacuaaaaugga

SEQ ID NO: 179 - RNA, 21 nt, Zea mays
ugaacggccccuacgcgcuga

SEQ ID NO: 180 - RNA, 21 nt, Zea mays
uugaggucaauacuagaguac

SEQ ID NO: 181 - RNA, 21 nt, Zea mays
uaggggugcaaugucaauggg

SEQ ID NO: 182 - RNA, 21 nt, Zea mays
uaugauaucaugacacgugga

SEQ ID NO: 183 - RNA, 21 nt, Zea mays
uauagaggacguugcuggaga

SEQ ID NO: 184 - RNA, 21 nt, Zea mays
ucuaaaaugaguggugaugau

SEQ ID NO: 185 - RNA, 21 nt, Zea mays
uaaaaagaaacggagggagua

SEQ ID NO: 186 - RNA, 21 nt, Zea mays
ucgauuacgguuggacuuaaa

SEQ ID NO: 187 - RNA, 21 nt, Zea mays
ugcaugcaacuuaauauggua

SEQ ID NO: 188 - RNA, 21 nt, Zea mays
ucaauuaagaacgucgguacc

SEQ ID NO: 189 - RNA, 21 nt, Zea mays
uaauccacauggauugagagc

SEQ ID NO: 190 - RNA, 21 nt, Zea mays
uuguguucauuugagcucuug

SEQ ID NO: 191 - RNA, 21 nt, Zea mays
uagguuuguacacauagugcg

SEQ ID NO: 192 - RNA, 21 nt, Zea mays
ucgagggcgaugaugaaggac

SEQ ID NO: 193 - RNA, 21 nt, Zea mays
ucaacacauguggauugaggu

SEQ ID NO: 194 - RNA, 21 nt, Zea mays
uuccgccacagcugguaucgg

SEQ ID NO: 195 - RNA, 21 nt, Zea mays
uagccagccgaacacgcccaa

SEQ ID NO: 196 - RNA, 19 nt, Oryza sativa
guugagauggccgaguugg

SEQ ID NO: 197 - RNA, 21 nt, Oryza sativa
uccgucccaaaauauagccac

SEQ ID NO: 198 - RNA, 21 nt, Oryza sativa
uggcgcuccacguaggcaaca

SEQ ID NO: 199 - RNA, 21 nt, Oryza sativa
ucagaucgguuccaaaucaau

SEQ ID NO: 200 - RNA, 20 nt, Oryza sativa
uuguccaacccagcccugau

SEQ ID NO: 201 - RNA, 21 nt, Oryza sativa
uacgacugaaugagauguacu

SEQ ID NO: 202 - RNA, 20 nt, Oryza sativa
uguaaguagccagccauauc

SEQ ID NO: 203 - RNA, 21 nt, Oryza sativa
uugggaacaccaaccggaacu

SEQ ID NO: 204 - RNA, 21 nt, Oryza sativa
uaccccucucuugccggcgcc

SEQ ID NO: 205 - RNA, 21 nt, Oryza sativa
ugaccaacaauuacucuauua

SEQ ID NO: 206 - RNA, 20 nt, Oryza sativa
ucaacggucaggauuuggua

SEQ ID NO: 207 - RNA, 21 nt, Oryza sativa
uauagggaggauaggcuuggc

SEQ ID NO: 208 - RNA, 21 nt, Oryza sativa
uccaacgaaucuagacagucc

SEQ ID NO: 209 - RNA, 20 nt, Oryza sativa
ucaacggugucauauauuua

SEQ ID NO: 210 - RNA, 21 nt, Oryza sativa
uagcacacggagugaguugga

SEQ ID NO: 211 - RNA, 20 nt, Oryza sativa
ucuccgcccgcagccgcucc

SEQ ID NO: 212 - RNA, 20 nt, Oryza sativa
uggagucggagcugcugggu

SEQ ID NO: 213 - RNA, 21 nt, Oryza sativa
uagucaaggcgaaggggaagg

SEQ ID NO: 214 - RNA, 20 nt, Oryza sativa
caauuauuaugggacagagg

SEQ ID NO: 215 - RNA, 20 nt, Oryza sativa
uacugcccugcuguagcugu

SEQ ID NO: 216 - RNA, 21 nt, Oryza sativa
uagccuuguuacggucgccgc

SEQ ID NO: 217 - RNA, 19 nt, Oryza sativa
aaauuacagggacuagaau

SEQ ID NO: 218 - RNA, 21 nt, Oryza sativa
uaaaggguggcccaaagugaa

SEQ ID NO: 219 - RNA, 20 nt, Oryza sativa
uugcuucuuuucgauagauu

SEQ ID NO: 220 - RNA, 21 nt, Oryza sativa
uaugggcaaugcuaagaaguc

SEQ ID NO: 221 - RNA, 21 nt, Oryza sativa
ugugcaaacuuccugaucucc

SEQ ID NO: 222 - RNA, 20 nt, Oryza sativa
ucaacuuauaaaaccgugca

SEQ ID NO: 223 - RNA, 20 nt, Oryza sativa
ugaaauuugcauuuccccgg

SEQ ID NO: 224 - RNA, 24 nt, Oryza sativa
gaacugccuuaaggaagucgaugc

SEQ ID NO: 225 - RNA, 20 nt, Oryza sativa
ggagguggaugcggaggcgg

SEQ ID NO: 226 - RNA, 19 nt, Oryza sativa
cgacgagacgaaucuuuug

SEQ ID NO: 227 - RNA, 19 nt, Oryza sativa
uacaaggccuggcuguaua

SEQ ID NO: 228 - RNA, 21 nt, Oryza sativa
ucagacggugcugggcgcccc

SEQ ID NO: 229 - RNA, 21 nt, Oryza sativa
ugaaacauuaaauguggacga

SEQ ID NO: 230 - RNA, 21 nt, Oryza sativa
uccaaagugcaaaugauggua

SEQ ID NO: 231 - RNA, 19 nt, Oryza sativa
cgacaugacggcggcggcg

SEQ ID NO: 232 - RNA, 21 nt, Oryza sativa
ucaggugauacuugcgaggua

SEQ ID NO: 233 - RNA, 21 nt, Oryza sativa
ucgcaggggauguuucguucu

SEQ ID NO: 234 - RNA, 20 nt, Oryza sativa
ugcgguagccaugcguugaa

SEQ ID NO: 235 - RNA, 21 nt, Oryza sativa
ucgggcucggcuugggcgacc

SEQ ID NO: 236 - RNA, 21 nt, Oryza sativa
uauuuuaguuucuauggucac

SEQ ID NO: 237 - RNA, 20 nt, Oryza sativa
gggauuaaccgaacaaggcc

SEQ ID NO: 238 - RNA, 21 nt, Oryza sativa
uggcggcagcggcgguggcgc

SEQ ID NO: 239 - RNA, 20 nt, Oryza sativa
uacucgugguuaugaauccu

SEQ ID NO: 240 - RNA, 19 nt, Oryza sativa
gaggaggaggaggagauga

SEQ ID NO: 241 - RNA, 20 nt, Oryza sativa
ucccuccguccccaaaaaaa

SEQ ID NO: 242 - RNA, 20 nt, Oryza sativa
aaggagggucuugagcucuu

SEQ ID NO: 243 - RNA, 21 nt, Oryza sativa
uccuugcuugcgugcuugguu

SEQ ID NO: 244 - RNA, 20 nt, Oryza sativa
ucggagaggggggacgucgc

SEQ ID NO: 245 - RNA, 24 nt, Oryza sativa
aaaaagucaacgaugucauauauu

SEQ ID NO: 246 - RNA, 21 nt, Oryza sativa
ugggaaaggaccauaauaccc

SEQ ID NO: 247 - RNA, 23 nt, Oryza sativa
acuagguuuguuuauuuugggac

SEQ ID NO: 248 - RNA, 20 nt, Oryza sativa
uauggcggguugguugaaug

SEQ ID NO: 249 - RNA, 20 nt, Oryza sativa
gcucugauaccaauuguugg

SEQ ID NO: 250 - RNA, 21 nt, Oryza sativa
uagaauaugucacauccagua

SEQ ID NO: 251 - RNA, 19 nt, Oryza sativa
ucaccugugacgggccgga

SEQ ID NO: 252 - RNA, 20 nt, Oryza sativa
cggcggcggcgucggcgcgg

SEQ ID NO: 253 - RNA, 24 nt, Oryza sativa
cucucccgccucgccccggcgacc

SEQ ID NO: 254 - RNA, 21 nt, Oryza sativa
gccaaggaugauuugccugua

SEQ ID NO: 255 - RNA, 21 nt, Oryza sativa
uggcucagcuguuugauguug

SEQ ID NO: 256 - RNA, 21 nt, Oryza sativa
ugcacgggaagcuugugugca

SEQ ID NO: 257 - RNA, 20 nt, Oryza sativa
uucaagaaaguccuuggaaa

SEQ ID NO: 258 - RNA, 21 nt, Oryza sativa
uccuccgcgcugccuuuggau

SEQ ID NO: 259 - RNA, 21 nt, Oryza sativa
ucggcgucgucuuuauucuca

SEQ ID NO: 260 - RNA, 19 nt, Oryza sativa
agcuaaaagccaaccaaag

SEQ ID NO: 261 - RNA, 24 nt, Oryza sativa
ggcggcggcggcggugguggugga

SEQ ID NO: 262 - RNA, 21 nt, Oryza sativa
ugagacccuucgaccagaccu

SEQ ID NO: 263 - RNA, 21 nt, Oryza sativa
uggcgucgucgaucuugucag

SEQ ID NO: 264 - RNA, 20 nt, Oryza sativa
ugacugggaugccacgugua

SEQ ID NO: 265 - RNA, 24 nt, Oryza sativa
ugucgucgcuaucgucggguccgu

SEQ ID NO: 266 - RNA, 21 nt, Oryza sativa
ugacguggcaaugauguggcg

SEQ ID NO: 267 - RNA, 20 nt, Oryza sativa
uuugcauaagucgaguguag

SEQ ID NO: 268 - RNA, 24 nt, Oryza sativa
uuccuauaugaacacuguugccag

SEQ ID NO: 269 - RNA, 21 nt, Oryza sativa
ugaggucaggacaggagggag

SEQ ID NO: 270 - RNA, 21 nt, Oryza sativa
ugccacguaggcgccauguca

SEQ ID NO: 271 - RNA, 20 nt, Oryza sativa
uaugaccaaccaaccgugua

SEQ ID NO: 272 - RNA, 20 nt, Oryza sativa
uacaagcccucucgguuccu

SEQ ID NO: 273 - RNA, 20 nt, Oryza sativa
cggcggcggcggcuguggug

SEQ ID NO: 274 - RNA, 19 nt, Oryza sativa
uccgcuugcgccgccgccg

SEQ ID NO: 275 - RNA, 21 nt, Oryza sativa
uuuuaaguggaucccguuugu

SEQ ID NO: 276 - RNA, 21 nt, Oryza sativa
uuccaucccaaccuagguuag

SEQ ID NO: 277 - RNA, 20 nt, Oryza sativa
uggcgaccauggcggaccac

SEQ ID NO: 278 - RNA, 23 nt, Oryza sativa
ccguaguucgauccugcgugggg

SEQ ID NO: 279 - RNA, 20 nt, Oryza sativa
ucgagugguaacgauuuaug

SEQ ID NO: 280 - RNA, 21 nt, Oryza sativa
guucccuucaagcacuucaca

SEQ ID NO: 281 - RNA, 20 nt, Oryza sativa
uggaggcuaauuuugcaaga

SEQ ID NO: 282 - RNA, 21 nt, Oryza sativa
uucguccggcgaggagcucgu

SEQ ID NO: 283 - RNA, 21 nt, Oryza sativa
ucggccugguacuuggcgaug

SEQ ID NO: 284 - RNA, 21 nt, Oryza sativa
uugcacagcagcaacgguggc

SEQ ID NO: 285 - RNA, 21 nt, Oryza sativa
uagcaccgugcagccgugcgc

SEQ ID NO: 286 - RNA, 21 nt, Oryza sativa
ugccacgucagcuugcugccc

SEQ ID NO: 287 - RNA, 21 nt, Oryza sativa
ugaauuuguaugcucgugcaa

SEQ ID NO: 288 - RNA, 21 nt, Oryza sativa
ucgaucugucuacguuguaac

SEQ ID NO: 289 - RNA, 21 nt, Oryza sativa
ucaaguuggugugaacgugua

SEQ ID NO: 290 - RNA, 21 nt, Oryza sativa
ucucaacuucuugugcuggaa

SEQ ID NO: 291 - RNA, 20 nt, Oryza sativa
uagagugacaaaugagaaua

SEQ ID NO: 292 - RNA, 19 nt, Oryza sativa
uccaccgccuccgccuccg

SEQ ID NO: 293 - RNA, 20 nt, Oryza sativa
ugcgagccggcggaggugaa

SEQ ID NO: 294 - RNA, 21 nt, Oryza sativa
uggcuagcacgguugguggca

SEQ ID NO: 295 - RNA, 20 nt, Oryza sativa
uauugccguaauacgaugca

SEQ ID NO: 296 - RNA, 21 nt, Oryza sativa
uugauuuucacgugucggucc

SEQ ID NO: 297 - RNA, 21 nt, Oryza sativa
ucgagaaggcguagaaucugc

SEQ ID NO: 298 - RNA, 21 nt, Oryza sativa
ucaauaaagcuagccgaaugg

SEQ ID NO: 299 - RNA, 20 nt, Oryza sativa
uaccggaugugacauauucu

SEQ ID NO: 300 - RNA, 21 nt, Oryza sativa
uacuaggauguguuacagcca

SEQ ID NO: 301 - RNA, 21 nt, Oryza sativa
uccaguggcuauauugacgca

SEQ ID NO: 302 - RNA, 21 nt, Oryza sativa
uuguguauacuugaagauuuu

SEQ ID NO: 303 - RNA, 20 nt, Oryza sativa
ugccgggagcugcacgaccg

SEQ ID NO: 304 - RNA, 20 nt, Oryza sativa
uccuugagcccacaugucag

SEQ ID NO: 305 - RNA, 21 nt, Oryza sativa
uccuuuuugaaauuugugugg

SEQ ID NO: 306 - RNA, 21 nt, Oryza sativa
uaaauuuugguaccucauggu

SEQ ID NO: 307 - RNA, 20 nt, Oryza sativa
ucagagggcuuaauagaugu

SEQ ID NO: 308 - RNA, 19 nt, Oryza sativa
gguggcggcggcgcggaag

SEQ ID NO: 309 - RNA, 21 nt, Oryza sativa
ucucguaacguugcuucucga

SEQ ID NO: 310 - RNA, 20 nt, Oryza sativa
ugcugccacucggcucgccu

SEQ ID NO: 311 - RNA, 24 nt, Oryza sativa
uaggcacaugguuccuaacuauga

SEQ ID NO: 312 - RNA, 20 nt, Oryza sativa
ugacgaguggucaaacguug

SEQ ID NO: 313 - RNA, 20 nt, Oryza sativa
ucgagguacuuuuugcugga

SEQ ID NO: 314 - RNA, 21 nt, Oryza sativa
uccauccccacaacgcauguc

SEQ ID NO: 315 - RNA, 21 nt, Oryza sativa
uacgugcuagaucuaucugau

SEQ ID NO: 316 - RNA, 21 nt, Oryza sativa
uacacauguauucuccuuuua

SEQ ID NO: 317 - RNA, 21 nt, Oryza sativa
uguccuauccaaguacuaggu

SEQ ID NO: 318 - RNA, 20 nt, Oryza sativa
uuccucugccucgugggccu

SEQ ID NO: 319 - RNA, 20 nt, Oryza sativa
uaucugguuuugcgauuggg

SEQ ID NO: 320 - RNA, 21 nt, Oryza sativa
uguccacaucgcauugugcca

SEQ ID NO: 321 - RNA, 21 nt, Oryza sativa
ucacauagaugucaaugaauc

SEQ ID NO: 322 - RNA, 19 nt, Oryza sativa
ggcggcggcgacuacggcg

SEQ ID NO: 323 - RNA, 21 nt, Oryza sativa
uuggagcccguuuggaccuau

SEQ ID NO: 324 - RNA, 21 nt, Oryza sativa
uaugugucuauaacauaugga

SEQ ID NO: 325 - RNA, 20 nt, Oryza sativa
ucauccccuaccuccagcca

SEQ ID NO: 326 - RNA, 20 nt, Oryza sativa
ugcaucgguuguugccauau

SEQ ID NO: 327 - RNA, 20 nt, Oryza sativa
ugggcugcuuuauuuuaugg

SEQ ID NO: 328 - RNA, 20 nt, Oryza sativa
uuuuuaggcggaccacuuaa

SEQ ID NO: 329 - RNA, 20 nt, Oryza sativa
uaggagggugacauggcaug

SEQ ID NO: 330 - RNA, 20 nt, Oryza sativa
ucacaugauccuaccuaccc

SEQ ID NO: 331 - RNA, 21 nt, Oryza sativa
uuaccuccgucccgugugauu

SEQ ID NO: 332 - RNA, 21 nt, Oryza sativa
uggcaugguugcauauugagc

SEQ ID NO: 333 - RNA, 21 nt, Oryza sativa
uuaacaggcccgcacgcaaaa

SEQ ID NO: 334 - RNA, 21 nt, Oryza sativa
uccgccgcucagugcugccgc

SEQ ID NO: 335 - RNA, 20 nt, Oryza sativa
uggcacuaccaucuuuggca

SEQ ID NO: 336 - RNA, 21 nt, Oryza sativa
uagggaauuugcuagguguga

SEQ ID NO: 337 - RNA, 21 nt, Oryza sativa
uacagacauugcuguguuggu

SEQ ID NO: 338 - RNA, 22 nt, Oryza sativa
acagccauauauauauauauau

SEQ ID NO: 339 - RNA, 21 nt, Oryza sativa
uaucccuggguauuauggucc

SEQ ID NO: 340 - RNA, 20 nt, Oryza sativa
ucccaccgagcagccggauc

SEQ ID NO: 341 - RNA, 21 nt, Oryza sativa
uacugcucacugacauuuggg

SEQ ID NO: 342 - RNA, 20 nt, Oryza sativa
uccuccccuucgacgacccc

SEQ ID NO: 343 - RNA, 21 nt, Oryza sativa
ccagucgaugcgcgcgccggc

SEQ ID NO: 344 - RNA, 20 nt, Oryza sativa
uugccuguacuguuugacaa

SEQ ID NO: 345 - RNA, 21 nt, Oryza sativa
uccgaauccgaaaaauggucc

SEQ ID NO: 346 - RNA, 20 nt, Oryza sativa
ucgccaccuucaucuccccg

SEQ ID NO: 347 - RNA, 21 nt, Oryza sativa
uccccaugcccugcgagagca

SEQ ID NO: 348 - RNA, 19 nt, Oryza sativa
cgccgccgccgucgccugu

SEQ ID NO: 349 - RNA, 21 nt, Oryza sativa
uacgacgacgaugcgacugcc

SEQ ID NO: 350 - RNA, 21 nt, Oryza sativa
uaccauauugaagagugugca

SEQ ID NO: 351 - RNA, 21 nt, Oryza sativa
ucaaacgguggaucuggaugg

SEQ ID NO: 352 - RNA, 21 nt, Oryza sativa
uccaugcgggcucuuaaguga

SEQ ID NO: 353 - RNA, 20 nt, Oryza sativa
ucgcaugcaggugggagugg

SEQ ID NO: 354 - RNA, 21 nt, Oryza sativa
ucggugacaagaugagggacc

SEQ ID NO: 355 - RNA, 20 nt, Oryza sativa
ucuuggaccugcacuggagc

SEQ ID NO: 356 - RNA, 21 nt, Oryza sativa
uggccacugccuucucaagca

SEQ ID NO: 357 - RNA, 20 nt, Oryza sativa
uauuucguggaacucguacu

SEQ ID NO: 358 - RNA, 20 nt, Oryza sativa
ucccaggaugcacuagcugg

SEQ ID NO: 359 - RNA, 20 nt, Oryza sativa
ccgccgccgccgcugcugcc

SEQ ID NO: 360 - RNA, 21 nt, Oryza sativa
uaagggcaucuaacgguguua

SEQ ID NO: 361 - RNA, 20 nt, Oryza sativa
ugcagguccaaggcuagccu

SEQ ID NO: 362 - RNA, 19 nt, Oryza sativa
cgggcggcggcgcgguggg

SEQ ID NO: 363 - RNA, 21 nt, Oryza sativa
uuuugcugcuauguacugucc

SEQ ID NO: 364 - RNA, 21 nt, Oryza sativa
ucugauaagcaacuggauggu

SEQ ID NO: 365 - RNA, 21 nt, Oryza sativa
uucgcauguagccacuaagga

SEQ ID NO: 366 - RNA, 20 nt, Oryza sativa
cggcggcggcagcggcgggg

SEQ ID NO: 367 - RNA, 20 nt, Oryza sativa
ucuggcgcacucccuagcca

SEQ ID NO: 368 - RNA, 20 nt, Oryza sativa
uagagcgccgcauugccgcc

SEQ ID NO: 369 - RNA, 20 nt, Oryza sativa
ucauaucuaauagguuaagg

SEQ ID NO: 370 - RNA, 20 nt, Oryza sativa
uuaggaugcgauguaaacau

SEQ ID NO: 371 - RNA, 21 nt, Oryza sativa
ucggauccacauguaagugac

SEQ ID NO: 372 - RNA, 20 nt, Oryza sativa
uauagucccgguuaugcaac

SEQ ID NO: 373 - RNA, 20 nt, Oryza sativa
uugaggguguggugaaugca

SEQ ID NO: 374 - RNA, 21 nt, Oryza sativa
ucccccacagcuagcaugugc

SEQ ID NO: 375 - RNA, 24 nt, Oryza sativa
agugggauacugaugucgaggucg

SEQ ID NO: 376 - RNA, 21 nt, Oryza sativa
uccuccgccgccgccucgccu

SEQ ID NO: 377 - RNA, 20 nt, Oryza sativa
ucugcaauggugagugccca

SEQ ID NO: 378 - RNA, 21 nt, Oryza sativa
uuuuggcaaugcaaaugaugu

SEQ ID NO: 379 - RNA, 21 nt, Oryza sativa
ucugaccgagguugauccgcc

SEQ ID NO: 380 - RNA, 21 nt, Oryza sativa
ugcucugcagucgacugcacc

SEQ ID NO: 381 - RNA, 19 nt, Oryza sativa
gagaucgaggaggaggagg

SEQ ID NO: 382 - RNA, 20 nt, Oryza sativa
ucaacuaucaaaaccggugu

SEQ ID NO: 383 - RNA, 20 nt, Oryza sativa
uuaugaguauacuaggugaa

SEQ ID NO: 384 - RNA, 20 nt, Oryza sativa
ucguggucgucguccaggua

SEQ ID NO: 385 - RNA, 21 nt, Oryza sativa
ucaauaaaaccuaaaaguaau

SEQ ID NO: 386 - RNA, 20 nt, Oryza sativa
uugcacugcuuccuuccagu

SEQ ID NO: 387 - RNA, 20 nt, Oryza sativa
ucauccaaugugcaaggaga

SEQ ID NO: 388 - RNA, 21 nt, Oryza sativa
ucagucacauauagaaaaaau

SEQ ID NO: 389 - RNA, 20 nt, Oryza sativa
uuuucguguuuaacguuuga

SEQ ID NO: 390 - RNA, 20 nt, Oryza sativa
ucuaaaaaaaacucaaccua

SEQ ID NO: 391 - RNA, 19 nt, Oryza sativa
cgccgccgccggcugccgc

SEQ ID NO: 392 - RNA, 20 nt, Oryza sativa
uuacagaaauauuauaccag

SEQ ID NO: 393 - RNA, 21 nt, Oryza sativa
uuagaugaccaucagcaaaca

SEQ ID NO: 394 - RNA, 21 nt, Oryza sativa
ucccgccgccggaggggagcc

SEQ ID NO: 395 - RNA, 20 nt, Oryza sativa
ucggcacgccaccaagccug

SEQ ID NO: 396 - RNA, 21 nt, Oryza sativa
ucgugggcgucugcgugcccc

SEQ ID NO: 397 - RNA, 19 nt, Oryza sativa
gagagagggagggaggagg

SEQ ID NO: 398 - RNA, 21 nt, Oryza sativa
ucuuucacuuccguucggcga

SEQ ID NO: 399 - RNA, 21 nt, Oryza sativa
ucagaguugucucuaaggaaa

SEQ ID NO: 400 - RNA, 21 nt, Oryza sativa
ucgagaguuuguguguauagg

SEQ ID NO: 401 - RNA, 21 nt, Oryza sativa
uuggaugcuugucaaugguau

SEQ ID NO: 402 - RNA, 21 nt, Oryza sativa
ucuuagugcuaugacuuuaga

SEQ ID NO: 403 - RNA, 20 nt, Oryza sativa
uggccgcugcacgugauggc

SEQ ID NO: 404 - RNA, 21 nt, Oryza sativa
uugccaaaugcaucucgccuu

SEQ ID NO: 405 - RNA, 20 nt, Oryza sativa
ucucugcacaucggauguuu

SEQ ID NO: 406 - RNA, 21 nt, Oryza sativa
ucucggagucaaaccgcuugu

SEQ ID NO: 407 - RNA, 20 nt, Oryza sativa
uaucacuaggaugucucauc

SEQ ID NO: 408 - RNA, 20 nt, Oryza sativa
ucgaucgcgacauuccagag

SEQ ID NO: 409 - RNA, 24 nt, Oryza sativa
uccagauucauuaugcuaugcuau

SEQ ID NO: 410 - RNA, 20 nt, Oryza sativa
ucccccgcaucgacacgcac

SEQ ID NO: 411 - RNA, 21 nt, Oryza sativa
uguuucuaugauugccagcug

SEQ ID NO: 412 - RNA, 20 nt, Oryza sativa
ucgcaggcggaccacauaag

SEQ ID NO: 413 - RNA, 21 nt, Oryza sativa
uggccaaugaugaaugcuuaa

SEQ ID NO: 414 - RNA, 20 nt, Oryza sativa
ucagucucugcuaaccuucu

SEQ ID NO: 415 - RNA, 20 nt, Oryza sativa
ucauaauacuacgaauuugg

SEQ ID NO: 416 - RNA, 19 nt, Oryza sativa
agaggagaggagaggggaa

SEQ ID NO: 417 - RNA, 20 nt, Oryza sativa
ucugauaccaaguugucacg

SEQ ID NO: 418 - RNA, 20 nt, Oryza sativa
uggaggaagaugaacuugac

SEQ ID NO: 419 - RNA, 21 nt, Oryza sativa
ugacaguuuauggcagggaag

SEQ ID NO: 420 - RNA, 21 nt, Oryza sativa
ugaugaucaauuugggaugga

SEQ ID NO: 421 - RNA, 21 nt, Oryza sativa
ugcugagcacaaacuagagaa

SEQ ID NO: 422 - RNA, 20 nt, Oryza sativa
uaagcagccgcacgcgaaaa

SEQ ID NO: 423 - RNA, 21 nt, Oryza sativa
ugcguggugugugugugucaa

SEQ ID NO: 424 - RNA, 19 nt, Oryza sativa
agcucugauaccauguuaa

SEQ ID NO: 425 - RNA, 21 nt, Oryza sativa
ucuagugucgauaucgaugau

SEQ ID NO: 426 - RNA, 24 nt, Oryza sativa
aggguauuuugguauuuuccuguc

SEQ ID NO: 427 - RNA, 21 nt, Oryza sativa
ugugaaauuguuauggaugcu

SEQ ID NO: 428 - RNA, 20 nt, Oryza sativa
uugcccagauccgucggugg

SEQ ID NO: 429 - RNA, 21 nt, Oryza sativa
uacaugcauguauugccuuuc

SEQ ID NO: 430 - RNA, 21 nt, Oryza sativa
ugccacguggacgaugacaug

SEQ ID NO: 431 - RNA, 20 nt, Oryza sativa
uccaagcugccggaggugac

SEQ ID NO: 432 - RNA, 21 nt, Oryza sativa
ucuaugaauguaaauugcaca

SEQ ID NO: 433 - RNA, 20 nt, Oryza sativa
uggacguggcggcggugcuc

SEQ ID NO: 434 - RNA, 19 nt, Oryza sativa
cagauguggaucuccaagg

SEQ ID NO: 435 - RNA, 24 nt, Oryza sativa
accucaacaugguaucagagcugg

SEQ ID NO: 436 - RNA, 20 nt, Oryza sativa
uaacacaaccgccagcgaaa

SEQ ID NO: 437 - RNA, 21 nt, Oryza sativa
uacucucugauaugggucgcu

SEQ ID NO: 438 - RNA, 19 nt, Oryza sativa
uccccgccgccuccucucc

SEQ ID NO: 439 - RNA, 21 nt, Oryza sativa
uagguugcuauauuaugggau

SEQ ID NO: 440 - RNA, 21 nt, Oryza sativa
uuucuacaauauaucggugac

SEQ ID NO: 441 - RNA, 21 nt, Oryza sativa
ucgcaggucagaauagaagcc

SEQ ID NO: 442 - RNA, 21 nt, Oryza sativa
uacaggaugaccuuuggcaau

SEQ ID NO: 443 - RNA, 19 nt, Oryza sativa
cggcgcggcggcuggcggc

SEQ ID NO: 444 - RNA, 21 nt, Oryza sativa
uugcaaauuugccacuguuuu

SEQ ID NO: 445 - RNA, 21 nt, Oryza sativa
uccgccgcgucgguggucgcc

SEQ ID NO: 446 - RNA, 21 nt, Oryza sativa
uccggcggcgaggugcagugg

SEQ ID NO: 447 - RNA, 20 nt, Oryza sativa
gcggcggagguggcgguggc

SEQ ID NO: 448 - RNA, 20 nt, Oryza sativa
uuggacacagaaacucgugg

SEQ ID NO: 449 - RNA, 21 nt, Oryza sativa
uuugguagucuaggaagcgug

SEQ ID NO: 450 - RNA, 21 nt, Oryza sativa
ucaucccuccaaaaucccuua

SEQ ID NO: 451 - RNA, 21 nt, Oryza sativa
ugcguugugucugcaucucuc

SEQ ID NO: 452 - RNA, 21 nt, Oryza sativa
uugacuaguggauugauuccc

SEQ ID NO: 453 - RNA, 21 nt, Oryza sativa
uaugaccacauggcgauuuag

SEQ ID NO: 454 - RNA, 21 nt, Oryza sativa
ucgaucaacaguugggccgau

SEQ ID NO: 455 - RNA, 21 nt, Oryza sativa
uugcagcguggcuacaugugg

SEQ ID NO: 456 - RNA, 21 nt, Oryza sativa
ucugucccaaaauguagcuac

SEQ ID NO: 457 - RNA, 21 nt, Oryza sativa
uagcugcuguguaauaauuca

SEQ ID NO: 458 - RNA, 21 nt, Oryza sativa
uaggcgcggaaacuuaugguu

SEQ ID NO: 459 - RNA, 20 nt, Oryza sativa
uuccacgagaagccaaugcc

SEQ ID NO: 460 - RNA, 22 nt, Oryza sativa
ggcggugggcggacgagugggc

SEQ ID NO: 461 - RNA, 20 nt, Oryza sativa
ugggcgcggcggcggaggcg

SEQ ID NO: 462 - RNA, 20 nt, Oryza sativa
ucgcuauggaauggauguag

SEQ ID NO: 463 - RNA, 21 nt, Oryza sativa
uaacaagaagcaugccggucu

SEQ ID NO: 464 - RNA, 22 nt, Oryza sativa
uaaaaaaacgaauggaguauua

SEQ ID NO: 465 - RNA, 21 nt, Oryza sativa
uauagccaacuacugucucca

SEQ ID NO: 466 - RNA, 21 nt, Oryza sativa
ugcgcgacgccaucgagggca

SEQ ID NO: 467 - RNA, 20 nt, Oryza sativa
uuguccaaagucaaaacguc

SEQ ID NO: 468 - RNA, 20 nt, Oryza sativa
uuuccgaucguuggaccuag

SEQ ID NO: 469 - RNA, 21 nt, Oryza sativa
uuuguccagauucguuguccu

SEQ ID NO: 470 - RNA, 20 nt, Oryza sativa
uagcagugcccaagaccuga

SEQ ID NO: 471 - RNA, 20 nt, Oryza sativa
uuauuuucaugugcaugucu

SEQ ID NO: 472 - RNA, 20 nt, Oryza sativa
uugaaccgggacuaaagaac

SEQ ID NO: 473 - RNA, 21 nt, Oryza sativa
ccaaaauaaaucaacuucuag

SEQ ID NO: 474 - RNA, 21 nt, Oryza sativa
ucgccagcgcggccuccuucu

SEQ ID NO: 475 - RNA, 21 nt, Oryza sativa
ugcccuggggugucuuagucc

SEQ ID NO: 476 - RNA, 20 nt, Oryza sativa
uugagcuccgaaaauucgcg

SEQ ID NO: 477 - RNA, 21 nt, Oryza sativa
ugcuuguugcgcuuguugccc

SEQ ID NO: 478 - RNA, 21 nt, Oryza sativa
uccccuuuaucccucuccucc

SEQ ID NO: 479 - RNA, 21 nt, Oryza sativa
ucaucacgaagaggccuauau

SEQ ID NO: 480 - RNA, 21 nt, Oryza sativa
ucagccaugauccaucagguu

SEQ ID NO: 481 - RNA, 20 nt, Oryza sativa
uauggugcuacagcaggcaa

SEQ ID NO: 482 - RNA, 21 nt, Oryza sativa
uuggguuugggccuaacuuga

SEQ ID NO: 483 - RNA, 21 nt, Oryza sativa
guucaagaaaguccuuggaaa

SEQ ID NO: 484 - RNA, 20 nt, Oryza sativa
cgggcggcgagaacaucagc

SEQ ID NO: 485 - RNA, 21 nt, Oryza sativa
aauccaucgauauggcugcaa

SEQ ID NO: 486 - RNA, 19 nt, Oryza sativa
cauggcugcugcugcugcu

SEQ ID NO: 487 - RNA, 21 nt, Oryza sativa
ucucauccaguccuaguuugc

SEQ ID NO: 488 - RNA, 19 nt, Oryza sativa
aauaagauaaguggucaaa

SEQ ID NO: 489 - RNA, 21 nt, Oryza sativa
uacucgugcaugacccaguug

SEQ ID NO: 490 - RNA, 24 nt, Oryza sativa
uguggcacugacauaugggccaga

SEQ ID NO: 491 - RNA, 21 nt, Oryza sativa
uccggugcuuuacccgcgaaa

SEQ ID NO: 492 - RNA, 21 nt, Oryza sativa
uuucgcgguagugcacucuuu

SEQ ID NO: 493 - RNA, 21 nt, Oryza sativa
uaaaggaugguauuccguucg

SEQ ID NO: 494 - RNA, 20 nt, Oryza sativa
ucucccucaaaggucuccaa

SEQ ID NO: 495 - RNA, 21 nt, Oryza sativa
uaucugcucgugucacgugcc

SEQ ID NO: 496 - RNA, 21 nt, Oryza sativa
uaguacgagguugacuuuuuu

SEQ ID NO: 497 - RNA, 21 nt, Oryza sativa
ugccgcuugccuguguguccu

SEQ ID NO: 498 - RNA, 21 nt, Oryza sativa
ucggagcugcugcaucggguc

SEQ ID NO: 499 - RNA, 21 nt, Oryza sativa
ucggaaacgauuugguaccau

SEQ ID NO: 500 - RNA, 20 nt, Oryza sativa
ugcuugcaggaauaagguua

SEQ ID NO: 501 - RNA, 20 nt, Oryza sativa
uucuaagugcaaucaugauu

SEQ ID NO: 502 - RNA, 21 nt, Oryza sativa
cucgugcaugauccaguuggu

SEQ ID NO: 503 - RNA, 24 nt, Oryza sativa
agacgaauuuacuaagccuaauua

SEQ ID NO: 504 - RNA, 20 nt, Oryza sativa
uaucuugugguaugaacuga

SEQ ID NO: 505 - RNA, 22 nt, Oryza sativa
ucgugucccaccaggcgugcca

SEQ ID NO: 506 - RNA, 21 nt, Oryza sativa
cggcggcggcggccggcggcc

SEQ ID NO: 507 - RNA, 20 nt, Oryza sativa
uuuguguuucuuugcauuac

SEQ ID NO: 508 - RNA, 21 nt, Oryza sativa
ucucucagugguaucauggua

SEQ ID NO: 509 - RNA, 21 nt, Oryza sativa
ucggaccauugucgggucggc

SEQ ID NO: 510 - RNA, 20 nt, Oryza sativa
ugugcgacuacggauccggc

SEQ ID NO: 511 - RNA, 20 nt, Oryza sativa
uuucacuagccuuugaucac

SEQ ID NO: 512 - RNA, 21 nt, Oryza sativa
ugaacuuguauguuuguggag

SEQ ID NO: 513 - RNA, 21 nt, Oryza sativa
uuagucccgguuaguguuauc

SEQ ID NO: 514 - RNA, 21 nt, Oryza sativa
uaaagucguccacauuuuacg

SEQ ID NO: 515 - RNA, 21 nt, Oryza sativa
ucgguagcggccgacaccgac

SEQ ID NO: 516 - RNA, 21 nt, Oryza sativa
ccgccgccgccgccgcucgac

SEQ ID NO: 517 - RNA, 21 nt, Oryza sativa
ucgucugcaggcggcgguggg

SEQ ID NO: 518 - RNA, 21 nt, Oryza sativa
ucgguggaggaguagagggaa

SEQ ID NO: 519 - RNA, 20 nt, Oryza sativa
ucucuuucuuccacaucauc

SEQ ID NO: 520 - RNA, 21 nt, Oryza sativa
cgagauuuguccacgucauca

SEQ ID NO: 521 - RNA, 20 nt, Oryza sativa
ugagucaaugacauaugggu

SEQ ID NO: 522 - RNA, 21 nt, Oryza sativa
uuacccaguccaaagugaaaa

SEQ ID NO: 523 - RNA, 23 nt, Oryza sativa
auauauauauauauaugaguugg

SEQ ID NO: 524 - RNA, 21 nt, Oryza sativa
uggcaauggcauccacgacgg

SEQ ID NO: 525 - RNA, 21 nt, Oryza sativa
ucggcacgacugcguagaugg

SEQ ID NO: 526 - RNA, 21 nt, Oryza sativa
ugcuuacauuuugagacggag

SEQ ID NO: 527 - RNA, 21 nt, Oryza sativa
ugacaugcuagcuagaguggu

SEQ ID NO: 528 - RNA, 20 nt, Oryza sativa
uccuucgucccauaauauaa

SEQ ID NO: 529 - RNA, 20 nt, Oryza sativa
uggcuggcuggcugcgagag

SEQ ID NO: 530 - RNA, 20 nt, Oryza sativa
uugauacaucuuaugauacu

SEQ ID NO: 531 - RNA, 20 nt, Oryza sativa
uucguguucaacguuugacu

SEQ ID NO: 532 - RNA, 21 nt, Oryza sativa
ucgagguacugguaucuuacg

SEQ ID NO: 533 - RNA, 20 nt, Oryza sativa
ugaguaagacgaguggucaa

SEQ ID NO: 534 - RNA, 22 nt, Oryza sativa
ucggaagacgccuucgugccgu

SEQ ID NO: 535 - RNA, 21 nt, Oryza sativa
ucaggauuuuauacauguaaa

SEQ ID NO: 536 - RNA, 21 nt, Oryza sativa
uugugcugaaaacgaugugau

SEQ ID NO: 537 - RNA, 20 nt, Oryza sativa
uuuaaaaaaagucaauggcg

SEQ ID NO: 538 - RNA, 21 nt, Oryza sativa
uccgcgccuaacuuugaucgu

SEQ ID NO: 539 - RNA, 20 nt, Oryza sativa
uaaagaacucgaacuugccu

SEQ ID NO: 540 - RNA, 21 nt, Oryza sativa
ucgagcccgggguguuguggc

SEQ ID NO: 541 - RNA, 21 nt, Oryza sativa
uuugggaguaacaaaaaagac

SEQ ID NO: 542 - RNA, 20 nt, Oryza sativa
ucucccucggcugcgagcgg

SEQ ID NO: 543 - RNA, 20 nt, Oryza sativa
ucaccacagccccguucaau

SEQ ID NO: 544 - RNA, 21 nt, Oryza sativa
uuggagcauguguaaagcuag

SEQ ID NO: 545 - RNA, 20 nt, Oryza sativa
uuaaaguuggacgcgaaaau

SEQ ID NO: 546 - RNA, 21 nt, Oryza sativa
ugccgguuuuuggucuagaac

SEQ ID NO: 547 - RNA, 21 nt, Oryza sativa
ugggccgccucggcuucgccc

SEQ ID NO: 548 - RNA, 20 nt, Oryza sativa
ugacggcuagguuucacgug

SEQ ID NO: 549 - RNA, 21 nt, Oryza sativa
ucgugcggcgaggcugcgaga

SEQ ID NO: 550 - RNA, 21 nt, Oryza sativa
ucccucauuauuugcauguca

SEQ ID NO: 551 - RNA, 21 nt, Oryza sativa
ugaggcuaccuaccucgggua

SEQ ID NO: 552 - RNA, 21 nt, Oryza sativa
uggcggggcaggugguguugc

SEQ ID NO: 553 - RNA, 21 nt, Oryza sativa
ucguguucaaguuugaucgcc

SEQ ID NO: 554 - RNA, 21 nt, Oryza sativa
ugaccauggguugcgcgguug

SEQ ID NO: 555 - RNA, 21 nt, Oryza sativa
ugugcacuuugcaaguucgug

SEQ ID NO: 556 - RNA, 21 nt, Oryza sativa
uagcaauucgguaagcauggu

SEQ ID NO: 557 - RNA, 21 nt, Oryza sativa
ugugguggcggcuuaucugau

SEQ ID NO: 558 - RNA, 21 nt, Oryza sativa
uggcaccaugucuggccuguc

SEQ ID NO: 559 - RNA, 20 nt, Oryza sativa
uagccaagaauggcuugccu

SEQ ID NO: 560 - RNA, 21 nt, Oryza sativa
ugauuagcguaugguuugaug

SEQ ID NO: 561 - RNA, 21 nt, Oryza sativa
uguguggcucuagugacuagu

SEQ ID NO: 562 - RNA, 21 nt, Oryza sativa
uguugugcaugguaccauggg

SEQ ID NO: 563 - RNA, 21 nt, Oryza sativa
gagccggugucgugguugucg

SEQ ID NO: 564 - RNA, 20 nt, Oryza sativa
ucguuguacuauaaaguguc

SEQ ID NO: 565 - RNA, 21 nt, Oryza sativa
uugaacugcccuacuacccca

SEQ ID NO: 566 - RNA, 21 nt, Oryza sativa
uuaacucgugaugucguggau

SEQ ID NO: 567 - RNA, 21 nt, Oryza sativa
uaguuaaaaauugacccgguc

SEQ ID NO: 568 - RNA, 19 nt, Oryza sativa
gugguggacuggugguggu

SEQ ID NO: 569 - RNA, 20 nt, Oryza sativa
ucaucagcagcccgccuccu

SEQ ID NO: 570 - RNA, 21 nt, Oryza sativa
ucacgaaccccuuccaguguc

SEQ ID NO: 571 - RNA, 20 nt, Oryza sativa
uaagucgacgaacacaacgg

SEQ ID NO: 572 - RNA, 21 nt, Oryza sativa
ugaaaauaguuacuauucacc

SEQ ID NO: 573 - RNA, 19 nt, Oryza sativa
aggucgccggcgccgccgc

SEQ ID NO: 574 - RNA, 21 nt, Oryza sativa
uuggcgcuuugaugacugcga

SEQ ID NO: 575 - RNA, 21 nt, Oryza sativa
ugcugacucgguagcuagcau

SEQ ID NO: 576 - RNA, 21 nt, Oryza sativa
uuagagaugcacuugauagug

SEQ ID NO: 577 - RNA, 20 nt, Oryza sativa
ugcagugaguucguaaggca

SEQ ID NO: 578 - RNA, 20 nt, Oryza sativa
uaugacgcuguugaccuuuu

SEQ ID NO: 579 - RNA, 21 nt, Oryza sativa
ugguaauaccaacugggacua

SEQ ID NO: 580 - RNA, 20 nt, Oryza sativa
augucauuguccacguggcg

SEQ ID NO: 581 - RNA, 23 nt, Oryza sativa
aacuaucgguuugcuauaacauu

SEQ ID NO: 582 - RNA, 20 nt, Oryza sativa
uguacaggucucgcccuuuu

SEQ ID NO: 583 - RNA, 21 nt, Oryza sativa
uauggaugggauuauguuuga

SEQ ID NO: 584 - RNA, 24 nt, Oryza sativa
agcuucugacagcugcaguuucuc

SEQ ID NO: 585 - RNA, 20 nt, Oryza sativa
ucauugugcuaugaaauauc

SEQ ID NO: 586 - RNA, 20 nt, Oryza sativa
uuggggauuuccugccggag

SEQ ID NO: 587 - RNA, 19 nt, Oryza sativa
ggcggcagcggcggcgagg

SEQ ID NO: 588 - RNA, 21 nt, Oryza sativa
ugggccgguccaaugaucagu

SEQ ID NO: 589 - RNA, 20 nt, Oryza sativa
ugcuacucgaucugaaccug

SEQ ID NO: 590 - RNA, 19 nt, Oryza sativa
gagccuugauguguaggau

SEQ ID NO: 591 - RNA, 21 nt, Oryza sativa
ucaguggcgguuugaccagag

SEQ ID NO: 592 - RNA, 21 nt, Oryza sativa
ucuucaacccugguugguucc

SEQ ID NO: 593 - RNA, 21 nt, Oryza sativa
cucgccgacggcauccaggac

SEQ ID NO: 594 - RNA, 20 nt, Oryza sativa
uugaggucgagucgucugac

SEQ ID NO: 595 - RNA, 20 nt, Oryza sativa
uacggcaugauguaguuguc

SEQ ID NO: 596 - RNA, 20 nt, Oryza sativa
ugcaguuaagucagaggauc

SEQ ID NO: 597 - RNA, 21 nt, Oryza sativa
ucacgcacacgauaugaugcu

SEQ ID NO: 598 - RNA, 21 nt, Oryza sativa
uuuggcuugcaacguuugacc

SEQ ID NO: 599 - RNA, 21 nt, Oryza sativa
uucuggggaaagaagcuuguc

SEQ ID NO: 600 - RNA, 20 nt, Oryza sativa
uccgccgucaucaucgcgcc

SEQ ID NO: 601 - RNA, 21 nt, Oryza sativa
ucuuguggcaagaacugagua

SEQ ID NO: 602 - RNA, 21 nt, Oryza sativa
ucggcuggcugcuuggucauc

SEQ ID NO: 603 - RNA, 21 nt, Oryza sativa
ugguuaucucaugcccucucu

SEQ ID NO: 604 - RNA, 20 nt, Oryza sativa
ugcaaauaugagauagaugg

SEQ ID NO: 605 - RNA, 19 nt, Oryza sativa
gcgauggcgauggcgauga

SEQ ID NO: 606 - RNA, 22 nt, Oryza sativa
gcgcucugccuccucaugcugg

SEQ ID NO: 607 - RNA, 20 nt, Oryza sativa
uaauuuuucaguucccguau

SEQ ID NO: 608 - RNA, 19 nt, Oryza sativa
cgccgucggccgccgccgc

SEQ ID NO: 609 - RNA, 19 nt, Oryza sativa
cccuccaaucucucccucu

SEQ ID NO: 610 - RNA, 21 nt, Oryza sativa
uugcgcgacaggucgaugugc

SEQ ID NO: 611 - RNA, 21 nt, Oryza sativa
ucaucgcgggugacaaaguua

SEQ ID NO: 612 - RNA, 20 nt, Oryza sativa
ugcagguggagcacuugauc

SEQ ID NO: 613 - RNA, 21 nt, Oryza sativa
uccggcccuguccgcgugcgu

SEQ ID NO: 614 - RNA, 21 nt, Oryza sativa
ugacguggacaaaucuuagac

SEQ ID NO: 615 - RNA, 20 nt, Oryza sativa
uagacagcuugcuuuugugc

SEQ ID NO: 616 - RNA, 21 nt, Oryza sativa
uaggcaugaaauacauucaua

SEQ ID NO: 617 - RNA, 21 nt, Oryza sativa
gcugcugcugguggugguggu

SEQ ID NO: 618 - RNA, 21 nt, Oryza sativa
uaauacaccacuaggagugcu

SEQ ID NO: 619 - RNA, 20 nt, Oryza sativa
gccaccacuccggcacccac

SEQ ID NO: 620 - RNA, 21 nt, Oryza sativa
ugugugugugugugcgcgcgc

SEQ ID NO: 621 - RNA, 21 nt, Oryza sativa
uagguagcaacauuuugggac

SEQ ID NO: 622 - RNA, 20 nt, Oryza sativa
ucuccuagcgcugagguggu

SEQ ID NO: 623 - RNA, 21 nt, Oryza sativa
uaugcguaagacggauucgua

SEQ ID NO: 624 - RNA, 21 nt, Oryza sativa
ugcaggcgggccauauaagcg

SEQ ID NO: 625 - RNA, 21 nt, Oryza sativa
uaucccaaaaaguguccaacu

SEQ ID NO: 626 - RNA, 19 nt, Oryza sativa
cggcuacgguggcgguggc

SEQ ID NO: 627 - RNA, 21 nt, Oryza sativa
uaaaaaacugguaauuugcua

SEQ ID NO: 628 - RNA, 21 nt, Oryza sativa
ucuuuagucccgauugguaau

SEQ ID NO: 629 - RNA, 21 nt, Oryza sativa
uggcucagucuggucaugggc

SEQ ID NO: 630 - RNA, 20 nt, Oryza sativa
uugggggcaucauagccgau

SEQ ID NO: 631 - RNA, 19 nt, Oryza sativa
ggaagagagaagagagaga

SEQ ID NO: 632 - RNA, 20 nt, Oryza sativa
uggcuggugggccccgucac

SEQ ID NO: 633 - RNA, 21 nt, Oryza sativa
uucauccgacaaagcaguagu

SEQ ID NO: 634 - RNA, 21 nt, Oryza sativa
uugcaaugugcauauugauga

SEQ ID NO: 635 - RNA, 20 nt, Oryza sativa
ccggcggcggaggaggagga

SEQ ID NO: 636 - RNA, 20 nt, Oryza sativa
ucgacgaacagaucuuuuuc

SEQ ID NO: 637 - RNA, 19 nt, Oryza sativa
ccgccccuuccuccgccgc

SEQ ID NO: 638 - RNA, 21 nt, Oryza sativa
uuacacuugcugaugcuuugg

SEQ ID NO: 639 - RNA, 21 nt, Oryza sativa
ugacucaaagucauguggcuu

SEQ ID NO: 640 - RNA, 21 nt, Oryza sativa
uauacuaggaugugucacauu

SEQ ID NO: 641 - RNA, 21 nt, Oryza sativa
ugccacugcuauucacgauau

SEQ ID NO: 642 - RNA, 21 nt, Oryza sativa
uuuuaggggucuauuugcgaa

SEQ ID NO: 643 - RNA, 21 nt, Oryza sativa
cggaccagcagcgccucaucu

SEQ ID NO: 644 - RNA, 24 nt, Oryza sativa
ggcacggaaaaucauggcugcacu

SEQ ID NO: 645 - RNA, 21 nt, Oryza sativa
ugagcugaugauggacaaaca

SEQ ID NO: 646 - RNA, 20 nt, Oryza sativa
ugcuacucccuccauccuaa

SEQ ID NO: 647 - RNA, 21 nt, Oryza sativa
uaggagcucggcgacuggauc

SEQ ID NO: 648 - RNA, 20 nt, Oryza sativa
ggugucgugguguaguuggu

SEQ ID NO: 649 - RNA, 21 nt, Oryza sativa
uuagccaagaauggcuugccu

SEQ ID NO: 650 - RNA, 20 nt, Oryza sativa
ugacagauguuaagggagca

SEQ ID NO: 651 - RNA, 20 nt, Oryza sativa
uggaccaacguaucagugac

SEQ ID NO: 652 - RNA, 21 nt, Oryza sativa
ugcgggaauuacuaagaaauu

SEQ ID NO: 653 - RNA, 21 nt, Oryza sativa
ugggcaaggaggguugaugga

SEQ ID NO: 654 - RNA, 21 nt, Oryza sativa
uaggacagagggaguagaugu

SEQ ID NO: 655 - RNA, 21 nt, Oryza sativa
uggucuugucuacguggcaug

SEQ ID NO: 656 - RNA, 20 nt, Oryza sativa
uuauauuugguggucuaggu

SEQ ID NO: 657 - RNA, 20 nt, Oryza sativa
ugacggauucggccccucgu

SEQ ID NO: 658 - RNA, 20 nt, Oryza sativa
uggugggugauauauuacau

SEQ ID NO: 659 - RNA, 21 nt, Oryza sativa
uacuaggaugugucacgucgu

SEQ ID NO: 660 - RNA, 20 nt, Oryza sativa
ucuccacuaguguaugcugu

SEQ ID NO: 661 - RNA, 20 nt, Oryza sativa
uccgccgcgcucgccuccuc

SEQ ID NO: 662 - RNA, 21 nt, Oryza sativa
ugcgucagaugaccggcggua

SEQ ID NO: 663 - RNA, 21 nt, Oryza sativa
ucaaugagugauuuaucugcu

SEQ ID NO: 664 - RNA, 20 nt, Oryza sativa
ucgcaaaugaaccgcggcca

SEQ ID NO: 665 - RNA, 20 nt, Oryza sativa
ugcgcacccucauccuccuc

SEQ ID NO: 666 - RNA, 21 nt, Oryza sativa
ucacgguaccaaaucauuucc

SEQ ID NO: 667 - RNA, 24 nt, Oryza sativa
gcguuuacccuuggauuggaugga

SEQ ID NO: 668 - RNA, 21 nt, Oryza sativa
uaaauggagagaacgaaagag

SEQ ID NO: 669 - RNA, 21 nt, Oryza sativa
uugcauggugucgccacgagc

SEQ ID NO: 670 - RNA, 21 nt, Oryza sativa
cgcgagcuggauguccuuggg

SEQ ID NO: 671 - RNA, 19 nt, Oryza sativa
ccgccgccgacgcugccgc

SEQ ID NO: 672 - RNA, 20 nt, Oryza sativa
uuuacgccacgaugccgauc

SEQ ID NO: 673 - RNA, 21 nt, Oryza sativa
ucgcucgcguugcugauggac

SEQ ID NO: 674 - RNA, 21 nt, Oryza sativa
ucaccugaaaauacauaaauc

SEQ ID NO: 675 - RNA, 21 nt, Oryza sativa
uaccgugagguaccgauaccu

SEQ ID NO: 676 - RNA, 21 nt, Oryza sativa
gcgaggagcgacgccaccucc

SEQ ID NO: 677 - RNA, 20 nt, Oryza sativa
ucacugagaucauccauguc

SEQ ID NO: 678 - RNA, 20 nt, Oryza sativa
aggucguggguucgacuccc

SEQ ID NO: 679 - RNA, 21 nt, Oryza sativa
ucuguugguuuguccucacau

SEQ ID NO: 680 - RNA, 20 nt, Oryza sativa
uacaugugcaaaccuaugga

SEQ ID NO: 681 - RNA, 21 nt, Oryza sativa
uugguacguauucguuccgua

SEQ ID NO: 682 - RNA, 20 nt, Oryza sativa
ucggcgacggcggcgguggg

SEQ ID NO: 683 - RNA, 20 nt, Oryza sativa
ugggaggguagccgcggucg

SEQ ID NO: 684 - RNA, 20 nt, Oryza sativa
uggagcugccgccaucgaug

SEQ ID NO: 685 - RNA, 20 nt, Oryza sativa
ugaaacaugaucggaugucu

SEQ ID NO: 686 - RNA, 21 nt, Oryza sativa
uguacuaagaugugucacauc

SEQ ID NO: 687 - RNA, 20 nt, Oryza sativa
ucggccuagacgaggaggag

SEQ ID NO: 688 - RNA, 21 nt, Oryza sativa
ccaaauucccaacuuuucauc

SEQ ID NO: 689 - RNA, 21 nt, Oryza sativa
uuggcuacaugagcaucgaga

SEQ ID NO: 690 - RNA, 22 nt, Oryza sativa
uuuccuaugacguccauuccaa

SEQ ID NO: 691 - RNA, 20 nt, Oryza sativa
uccuugagaagguaucggga

SEQ ID NO: 692 - RNA, 21 nt, Oryza sativa
ugcgcuggcguggacguggcc

SEQ ID NO: 693 - RNA, 21 nt, Oryza sativa
uccuaggaugugucauauccc

SEQ ID NO: 694 - RNA, 20 nt, Oryza sativa
gaugaaauggguuuggggaa

SEQ ID NO: 695 - RNA, 20 nt, Oryza sativa
cggcggcggcgguggcggcu

SEQ ID NO: 696 - RNA, 25 nt, Oryza sativa
ccaugcgcugacgugacauugccac

SEQ ID NO: 697 - RNA, 21 nt, Oryza sativa
uacauuuggaaccagagggac

SEQ ID NO: 698 - RNA, 19 nt, Oryza sativa
cgcggcgguggcgguggcg

SEQ ID NO: 699 - RNA, 21 nt, Oryza sativa
uugggaauuuuagugaaguug

SEQ ID NO: 700 - RNA, 21 nt, Oryza sativa
uacgaacauaacgguguaauc

SEQ ID NO: 701 - RNA, 20 nt, Oryza sativa
ugccuugcucuugagcugac

SEQ ID NO: 702 - RNA, 20 nt, Oryza sativa
uggggcaugcgaacacagcc

SEQ ID NO: 703 - RNA, 21 nt, Oryza sativa
uucuaguacuacgaaucuggu

SEQ ID NO: 704 - RNA, 20 nt, Oryza sativa
ucgcaguauaugacauaugg

SEQ ID NO: 705 - RNA, 21 nt, Oryza sativa
uuucauguaacuugcacuuau

SEQ ID NO: 706 - RNA, 21 nt, Oryza sativa
ugcgguuauuguguugcagcc

SEQ ID NO: 707 - RNA, 21 nt, Oryza sativa
uuccugguacacuuuaauacc

SEQ ID NO: 708 - RNA, 21 nt, Oryza sativa
ugaccugaguaucgugccuga

SEQ ID NO: 709 - RNA, 21 nt, Oryza sativa
uggccacgucgaggaugccgu

SEQ ID NO: 710 - RNA, 20 nt, Oryza sativa
uucaagcaguuccacuauuc

SEQ ID NO: 711 - RNA, 20 nt, Oryza sativa
ucuuccaguguagcuugauu

SEQ ID NO: 712 - RNA, 21 nt, Oryza sativa
ugaccuacaacuuuguaguug

SEQ ID NO: 713 - RNA, 22 nt, Oryza sativa
uucgagugggauacugaugucg

SEQ ID NO: 714 - RNA, 25 nt, Oryza sativa
cggcggcggcggcggcggcugcggc

SEQ ID NO: 715 - RNA, 21 nt, Oryza sativa
ucacgguacuaaaucguuucu

SEQ ID NO: 716 - RNA, 20 nt, Oryza sativa
uguccgccugcgaaaauaag

SEQ ID NO: 717 - RNA, 21 nt, Oryza sativa
uggauuguaauuacuaguucu

SEQ ID NO: 718 - RNA, 20 nt, Oryza sativa
uaccgucggucucgcacaac

SEQ ID NO: 719 - RNA, 20 nt, Oryza sativa
uaccggaugugacauauuuu

SEQ ID NO: 720 - RNA, 21 nt, Oryza sativa
uguaugcugcaguugaguggg

SEQ ID NO: 721 - RNA, 21 nt, Oryza sativa
uacccuaccaaaauuuugaua

SEQ ID NO: 722 - RNA, 21 nt, Oryza sativa
ucaccgugaccguuugcuucc

SEQ ID NO: 723 - RNA, 20 nt, Oryza sativa
uuuggacagaauaugucuca

SEQ ID NO: 724 - RNA, 24 nt, Oryza sativa
uuaguaggacuagaaugggccaaa

SEQ ID NO: 725 - RNA, 20 nt, Oryza sativa
ucuggaaggacagccgaugg

SEQ ID NO: 726 - RNA, 19 nt, Oryza sativa
uguguguaugugugcgugu

SEQ ID NO: 727 - RNA, 21 nt, Oryza sativa
uguggccaaauaacgcugcca

SEQ ID NO: 728 - RNA, 21 nt, Oryza sativa
ucagcgagauugucacauacu

SEQ ID NO: 729 - RNA, 21 nt, Oryza sativa
uucguaguagcagaaaguguc

SEQ ID NO: 730 - RNA, 21 nt, Oryza sativa
uuuggccauucuauuggagau

SEQ ID NO: 731 - RNA, 19 nt, Oryza sativa
gccgccgccgccggucgcc

SEQ ID NO: 732 - RNA, 20 nt, Oryza sativa
ccaccaccgccacgccgccg

SEQ ID NO: 733 - RNA, 20 nt, Oryza sativa
gcgguggcggcgguggcggc

SEQ ID NO: 734 - RNA, 21 nt, Oryza sativa
uauuacagaugccgguuuuuu

SEQ ID NO: 735 - RNA, 21 nt, Oryza sativa
uaucaccaucagcugaccuuu

SEQ ID NO: 736 - RNA, 21 nt, Oryza sativa
ucacgucugcgaaaaucgucc

SEQ ID NO: 737 - RNA, 20 nt, Oryza sativa
ugguauauggauaaaaguug

SEQ ID NO: 738 - RNA, 21 nt, Oryza sativa
ugcagguccaaggcuagccuu

SEQ ID NO: 739 - RNA, 21 nt, Oryza sativa
uuagugcguuuugcaaauucg

SEQ ID NO: 740 - RNA, 21 nt, Oryza sativa
uggucaaacguuacaaacaaa

SEQ ID NO: 741 - RNA, 21 nt, Oryza sativa
uccgccgccgagcucgcccgc

SEQ ID NO: 742 - RNA, 21 nt, Oryza sativa
uaacaaguauaugguuaguau

SEQ ID NO: 743 - RNA, 19 nt, Oryza sativa
cugcccgcgcccgagcucc

SEQ ID NO: 744 - RNA, 21 nt, Oryza sativa
uaggaccggaugagauguauc

SEQ ID NO: 745 - RNA, 21 nt, Oryza sativa
uucaacaacaaguuaugaugc

SEQ ID NO: 746 - RNA, 20 nt, Oryza sativa
ugugcauugagaagaugcug

SEQ ID NO: 747 - RNA, 20 nt, Oryza sativa
ugggagcagccgccgcgcaa

SEQ ID NO: 748 - RNA, 20 nt, Oryza sativa
uuuuuacuuuggaccggaua

SEQ ID NO: 749 - RNA, 24 nt, Oryza sativa
uuacucccuccguccuagaauaua

SEQ ID NO: 750 - RNA, 19 nt, Oryza sativa
ucugugauuugauuugugu

SEQ ID NO: 751 - RNA, 21 nt, Oryza sativa
uccgccaggugugcggcugcc

SEQ ID NO: 752 - RNA, 21 nt, Oryza sativa
ucaugcaacgucaaagacaaa

SEQ ID NO: 753 - RNA, 21 nt, Oryza sativa
uacaaggugugcucacgugga

SEQ ID NO: 754 - RNA, 21 nt, Oryza sativa
uggugagccuuccuggcuaag

SEQ ID NO: 755 - RNA, 21 nt, Oryza sativa
gguaccgccgccgccgccgcc

SEQ ID NO: 756 - RNA, 21 nt, Oryza sativa
uuccaagcgggccacuuaagc

SEQ ID NO: 757 - RNA, 20 nt, Oryza sativa
ugucuguccauuugcuggcg

SEQ ID NO: 758 - RNA, 19 nt, Oryza sativa
ucccucugugugugugugu

SEQ ID NO: 759 - RNA, 21 nt, Oryza sativa
uuccaggacucugaagccgau

SEQ ID NO: 760 - RNA, 20 nt, Oryza sativa
uccaaaccgaacaaggccuc

SEQ ID NO: 761 - RNA, 20 nt, Oryza sativa
uggaauaugaaugugugguc

SEQ ID NO: 762 - RNA, 21 nt, Oryza sativa
ugcaucgguuuuaauaguugg

SEQ ID NO: 763 - RNA, 21 nt, Oryza sativa
ucacgaggugacauagcauag

SEQ ID NO: 764 - RNA, 21 nt, Oryza sativa
ucccaguccuugccauaagua

SEQ ID NO: 765 - RNA, 21 nt, Oryza sativa
uagcauugaccacauucauau

SEQ ID NO: 766 - RNA, 19 nt, Oryza sativa
aucgccaacguccucgccg

SEQ ID NO: 767 - RNA, 21 nt, Oryza sativa
uccgucacuuaauauaaggua

SEQ ID NO: 768 - RNA, 20 nt, Oryza sativa
ucccccgccgccgcugccuc

SEQ ID NO: 769 - RNA, 19 nt, Oryza sativa
ugccgugcugacguggcug

SEQ ID NO: 770 - RNA, 20 nt, Oryza sativa
uacauagggugucgcauggu

SEQ ID NO: 771 - RNA, 20 nt, Oryza sativa
uagaguaccguggaguagac

SEQ ID NO: 772 - RNA, 21 nt, Oryza sativa
ucaucacgaguuaaaauuuaa

SEQ ID NO: 773 - RNA, 20 nt, Oryza sativa
uugguugcaugcgaucgagu

SEQ ID NO: 774 - RNA, 20 nt, Oryza sativa
ugggccagcuagggguucgg

SEQ ID NO: 775 - RNA, 20 nt, Oryza sativa
uugguagugccaaaauuuug

SEQ ID NO: 776 - RNA, 21 nt, Oryza sativa
uucggccgaaccaugguguuc

SEQ ID NO: 777 - RNA, 20 nt, Oryza sativa
gucugggugguguaguuggu

SEQ ID NO: 778 - RNA, 24 nt, Oryza sativa
agacuaacggucauacuguuuaaa

SEQ ID NO: 779 - RNA, 20 nt, Oryza sativa
uacgccgccggucggaccgc

SEQ ID NO: 780 - RNA, 20 nt, Oryza sativa
uccgucccaaaaaaaaccca

SEQ ID NO: 781 - RNA, 21 nt, Oryza sativa
uauccgccccuauacuguguc

SEQ ID NO: 782 - RNA, 20 nt, Oryza sativa
ugaguccacggccuauuuuu

SEQ ID NO: 783 - RNA, 20 nt, Oryza sativa
acuuaggguguguuugguuc

SEQ ID NO: 784 - RNA, 22 nt, Oryza sativa
aaguugagauggccgaguuggu

SEQ ID NO: 785 - RNA, 21 nt, Oryza sativa
ucggggaaguucgaucgaucc

SEQ ID NO: 786 - RNA, 21 nt, Oryza sativa
ucccucaacuaucguccgagu

SEQ ID NO: 787 - RNA, 20 nt, Oryza sativa
ugaauguuggugugagugug

SEQ ID NO: 788 - RNA, 21 nt, Oryza sativa
uugguugaccagccgacuagc

SEQ ID NO: 789 - RNA, 21 nt, Oryza sativa
uuagccucaaaagauucgucu

SEQ ID NO: 790 - RNA, 21 nt, Oryza sativa
ugcggccgaugucucguaccu

SEQ ID NO: 791 - RNA, 21 nt, Oryza sativa
ucaccggagagaagguggcgg

SEQ ID NO: 792 - RNA, 21 nt, Oryza sativa
uuuagguacuauuuucacgag

SEQ ID NO: 793 - RNA, 20 nt, Oryza sativa
uguguucaacuuaugcccag

SEQ ID NO: 794 - RNA, 21 nt, Oryza sativa
ucgccgcuauguacuccgccu

SEQ ID NO: 795 - RNA, 20 nt, Oryza sativa
ucaaacauguguccaaaagu

SEQ ID NO: 796 - RNA, 21 nt, Oryza sativa
ucaucuacaugugugguucuu

SEQ ID NO: 797 - RNA, 22 nt, Oryza sativa
cuccuccuccgccucaccgccg

SEQ ID NO: 798 - RNA, 21 nt, Oryza sativa
uaggguugccaccuuaauggg

SEQ ID NO: 799 - RNA, 21 nt, Oryza sativa
ucuuggccuccucucgcugcu

SEQ ID NO: 800 - RNA, 21 nt, Oryza sativa
gguuugaaucuggacaugcau

SEQ ID NO: 801 - RNA, 20 nt, Oryza sativa
uugaacgaauacaacggcgu

SEQ ID NO: 802 - RNA, 20 nt, Oryza sativa
accgcauagcgcaguggauu

SEQ ID NO: 803 - RNA, 21 nt, Oryza sativa
uaaucaguuuggggagacaaa

SEQ ID NO: 804 - RNA, 21 nt, Oryza sativa
uggcguguuuuggagccgugg

SEQ ID NO: 805 - RNA, 21 nt, Oryza sativa
uuccuauuauccaaacacacc

SEQ ID NO: 806 - RNA, 20 nt, Oryza sativa
uccccucccucaaccucgcc

SEQ ID NO: 807 - RNA, 21 nt, Oryza sativa
uauauagccuaaccaucuuag

SEQ ID NO: 808 - RNA, 21 nt, Oryza sativa
uagagucaccaacgaccucaa

SEQ ID NO: 809 - RNA, 20 nt, Oryza sativa
uuguaaaccauuggugaggc

SEQ ID NO: 810 - RNA, 21 nt, Oryza sativa
ucacagccgcaaguggauggu

SEQ ID NO: 811 - RNA, 21 nt, Oryza sativa
uagguugcaauauuuugggac

SEQ ID NO: 812 - RNA, 20 nt, Oryza sativa
uccaccaccguugcaucggc

SEQ ID NO: 813 - RNA, 21 nt, Oryza sativa
uuaagacgaccgccagcgaaa

SEQ ID NO: 814 - RNA, 21 nt, Oryza sativa
uauuggaggugauauucccua

SEQ ID NO: 815 - RNA, 21 nt, Oryza sativa
ccggcggccaguacuucgacc

SEQ ID NO: 816 - RNA, 20 nt, Oryza sativa
uaugcauguuuugggugugu

SEQ ID NO: 817 - RNA, 20 nt, Oryza sativa
uucgcgggggguauacugcu

SEQ ID NO: 818 - RNA, 21 nt, Oryza sativa
uuggcuccguguacuccggcu

SEQ ID NO: 819 - RNA, 20 nt, Oryza sativa
uaucaggaccuuauacaugu

SEQ ID NO: 820 - RNA, 21 nt, Oryza sativa
ucaguggcagagcuuagugga

SEQ ID NO: 821 - RNA, 21 nt, Oryza sativa
ucagcgccacauaggauucua

SEQ ID NO: 822 - RNA, 21 nt, Oryza sativa
uaguacuaggaugugucgcau

SEQ ID NO: 823 - RNA, 21 nt, Oryza sativa
ugcgcaaccauucccauggcc

SEQ ID NO: 824 - RNA, 20 nt, Oryza sativa
gaauaagacgaguggugaaa

SEQ ID NO: 825 - RNA, 21 nt, Oryza sativa
ucaaagagugcuuacugcagg

SEQ ID NO: 826 - RNA, 21 nt, Oryza sativa
uggucaucuagcuacccgugc

SEQ ID NO: 827 - RNA, 20 nt, Oryza sativa
uaaaucuagacacccguauu

SEQ ID NO: 828 - RNA, 21 nt, Oryza sativa
ugggacuaucucgguuagguc

SEQ ID NO: 829 - RNA, 21 nt, Oryza sativa
cgcgagguggagaagcagggc

SEQ ID NO: 830 - RNA, 20 nt, Oryza sativa
ucuaggacagaggcaguacu

SEQ ID NO: 831 - RNA, 21 nt, Oryza sativa
uguaaagagaaaaccagcuuc

SEQ ID NO: 832 - RNA, 20 nt, Oryza sativa
uugacguuguuagugugugg

SEQ ID NO: 833 - RNA, 20 nt, Oryza sativa
ucccucuaccuggcgcgcca

SEQ ID NO: 834 - RNA, 20 nt, Oryza sativa
uuguccauucuacaauaugc

SEQ ID NO: 835 - RNA, 20 nt, Oryza sativa
uagguauugcaacgcaaacc

SEQ ID NO: 836 - RNA, 21 nt, Oryza sativa
uugugucugguuuuucgguug

SEQ ID NO: 837 - RNA, 20 nt, Oryza sativa
ugcuccaaccaucaucagga

SEQ ID NO: 838 - RNA, 20 nt, Oryza sativa
uuacuacacaguuucgcgag

SEQ ID NO: 839 - RNA, 21 nt, Oryza sativa
uggcguuggcguuggcggcgg

SEQ ID NO: 840 - RNA, 20 nt, Oryza sativa
ucacuaccccuugcuuaucu

SEQ ID NO: 841 - RNA, 20 nt, Oryza sativa
ucacggaugguugucaucgg

SEQ ID NO: 842 - RNA, 21 nt, Oryza sativa
uagcccucgacgagaccuaca

SEQ ID NO: 843 - RNA, 21 nt, Oryza sativa
ucgugcuaucgucacgugcuu

SEQ ID NO: 844 - RNA, 21 nt, Oryza sativa
uggcaagucuccucggcuacc

SEQ ID NO: 845 - RNA, 21 nt, Oryza sativa
uguguuuaaauauuugaugug

SEQ ID NO: 846 - RNA, 21 nt, Oryza sativa
ucaugcgggcgaacucgucga

SEQ ID NO: 847 - RNA, 20 nt, Oryza sativa
uccuaagcagccgcaugcga

SEQ ID NO: 848 - RNA, 21 nt, Oryza sativa
ugcagaauggacugucguugc

SEQ ID NO: 849 - RNA, 21 nt, Oryza sativa
uuguguuaggaaccuaggauc

SEQ ID NO: 850 - RNA, 20 nt, Oryza sativa
uggccuugauucacaugcac

SEQ ID NO: 851 - RNA, 20 nt, Oryza sativa
ugaguuccccuacgaguguu

SEQ ID NO: 852 - RNA, 20 nt, Oryza sativa
ugguuucgcugauguggcau

SEQ ID NO: 853 - RNA, 21 nt, Oryza sativa
ucaaauguugaucacauauua

SEQ ID NO: 854 - RNA, 21 nt, Oryza sativa
ugcacuuaaaaugggacugag

SEQ ID NO: 855 - RNA, 20 nt, Oryza sativa
ucacaugcgggccucuuaag

SEQ ID NO: 856 - RNA, 21 nt, Oryza sativa
ucacguccauguggcauugcc

SEQ ID NO: 857 - RNA, 21 nt, Oryza sativa
uggaaaguugggagauugggg

SEQ ID NO: 858 - RNA, 20 nt, Oryza sativa
ugcuagagagggcuccgagc

SEQ ID NO: 859 - RNA, 21 nt, Oryza sativa
ugggcaggccggccgacgggu

SEQ ID NO: 860 - RNA, 21 nt, Oryza sativa
ucaaccguaaagccgaauaua

SEQ ID NO: 861 - RNA, 20 nt, Oryza sativa
ugauaccuauccgugacggg

SEQ ID NO: 862 - RNA, 21 nt, Oryza sativa
uuaggauacgucucauccggu

SEQ ID NO: 863 - RNA, 21 nt, Oryza sativa
ugaccaaaucuuguccugaac

SEQ ID NO: 864 - RNA, 19 nt, Oryza sativa
ugcacgacgccgccgccgc

SEQ ID NO: 865 - RNA, 20 nt, Oryza sativa
uuucugugucuaacauuuga

SEQ ID NO: 866 - RNA, 21 nt, Oryza sativa
uguucuucagcagccguguca

SEQ ID NO: 867 - RNA, 20 nt, Oryza sativa
uaaggugucgcauaggguau

SEQ ID NO: 868 - RNA, 19 nt, Oryza sativa
cggcggcgggcgagcgcgg

SEQ ID NO: 869 - RNA, 21 nt, Oryza sativa
uccgagaaguagccucgagcg

SEQ ID NO: 870 - RNA, 21 nt, Oryza sativa
uuacagaguauuagaagagug

SEQ ID NO: 871 - RNA, 20 nt, Oryza sativa
ugggccgcgauguugaaugg

SEQ ID NO: 872 - RNA, 21 nt, Oryza sativa
ugaaggcggggcuuguacugc

SEQ ID NO: 873 - RNA, 19 nt, Oryza sativa
gccgccgccgccgcgcgca

SEQ ID NO: 874 - RNA, 21 nt, Oryza sativa
ucaccggccggccauggcaca

SEQ ID NO: 875 - RNA, 21 nt, Oryza sativa
ucuccgggcuacauuugaauu

SEQ ID NO: 876 - RNA, 21 nt, Oryza sativa
ugaacaguguuauucggauau

SEQ ID NO: 877 - RNA, 21 nt, Oryza sativa
uucgagccucucucaccccac

SEQ ID NO: 878 - RNA, 20 nt, Oryza sativa
uuggaggaugauuuuguaac

SEQ ID NO: 879 - RNA, 19 nt, Oryza sativa
ugcgccagcggcacuggua

SEQ ID NO: 880 - RNA, 21 nt, Oryza sativa
ugucguuuuagacaaggguaa

SEQ ID NO: 881 - RNA, 21 nt, Oryza sativa
ucucugucgcucgcagucgca

SEQ ID NO: 882 - RNA, 21 nt, Oryza sativa
uccaaaaaucauuuucggaac

SEQ ID NO: 883 - RNA, 21 nt, Oryza sativa
uagugaggugaaggagagaag

SEQ ID NO: 884 - RNA, 21 nt, Oryza sativa
uauaaagggaccuugagauca

SEQ ID NO: 885 - RNA, 20 nt, Oryza sativa
ucggaaagggucaaauuguc

SEQ ID NO: 886 - RNA, 21 nt, Oryza sativa
uaagcuaauuuggacuggcca

SEQ ID NO: 887 - RNA, 20 nt, Oryza sativa
uaggaugggaugggacauau

SEQ ID NO: 888 - RNA, 21 nt, Oryza sativa
ucacgcccaaaguaccuagau

SEQ ID NO: 889 - RNA, 20 nt, Oryza sativa
guauugcgcggucagaccgg

SEQ ID NO: 890 - RNA, 21 nt, Oryza sativa
uuggaacaagggcgaugcaga

SEQ ID NO: 891 - RNA, 19 nt, Oryza sativa
uucccccuaccuggcgcgc

SEQ ID NO: 892 - RNA, 22 nt, Oryza sativa
augcugagaguagauagagugu

SEQ ID NO: 893 - RNA, 20 nt, Oryza sativa
ucguuuacuauuggucgccg

SEQ ID NO: 894 - RNA, 21 nt, Oryza sativa
uggcagucaguaguauaguac

SEQ ID NO: 895 - RNA, 20 nt, Oryza sativa
ucgugguccaacaugauagu

SEQ ID NO: 896 - RNA, 20 nt, Oryza sativa
uguaacaccgugcauaccac

SEQ ID NO: 897 - RNA, 21 nt, Oryza sativa
uggaugagcuguuggauagga

SEQ ID NO: 898 - RNA, 21 nt, Oryza sativa
uguagcuucaagguauaucuc

SEQ ID NO: 899 - RNA, 20 nt, Oryza sativa
uaaucaggcgauuguggguu

SEQ ID NO: 900 - RNA, 21 nt, Oryza sativa
uccaauacagcagcagccgau

SEQ ID NO: 901 - RNA, 21 nt, Oryza sativa
ugacuacucuugucugaaucu

SEQ ID NO: 902 - RNA, 21 nt, Oryza sativa
ugcuuugguugcugcaugguc

SEQ ID NO: 903 - RNA, 21 nt, Oryza sativa
uagauugcuuucaaggucauu

SEQ ID NO: 904 - RNA, 21 nt, Oryza sativa
ugaacagugucaaacaguguc

SEQ ID NO: 905 - RNA, 21 nt, Oryza sativa
uaguaccauauaggugucgau

SEQ ID NO: 906 - RNA, 20 nt, Oryza sativa
uggccggcgacgguucgccu

SEQ ID NO: 907 - RNA, 20 nt, Oryza sativa
uguguccagguucaaacuua

SEQ ID NO: 908 - RNA, 21 nt, Oryza sativa
ucucgaagaugucguugauga

SEQ ID NO: 909 - RNA, 21 nt, Oryza sativa
ugugacacauucuaguacaac

SEQ ID NO: 910 - RNA, 20 nt, Oryza sativa
uuaugcggaccgcacgagau

SEQ ID NO: 911 - RNA, 21 nt, Oryza sativa
uccuccucucucgccgcccua

SEQ ID NO: 912 - RNA, 20 nt, Oryza sativa
ucgacuuaaguggaccgcac

SEQ ID NO: 913 - RNA, 21 nt, Oryza sativa
ucgccgcggacagcugcuuau

SEQ ID NO: 914 - RNA, 21 nt, Oryza sativa
ugcugugugggacgaagugag

SEQ ID NO: 915 - RNA, 21 nt, Oryza sativa
ugauccgugcagcuuggaaga

SEQ ID NO: 916 - RNA, 21 nt, Oryza sativa
uccgucccaaaauauaaagga

SEQ ID NO: 917 - RNA, 21 nt, Oryza sativa
ugcugcauaacuacgccgugu

SEQ ID NO: 918 - RNA, 20 nt, Oryza sativa
uugcuugcacuauuuaacca

SEQ ID NO: 919 - RNA, 21 nt, Oryza sativa
uaagauaaugccaugaauucg

SEQ ID NO: 920 - RNA, 21 nt, Oryza sativa
ugggcacuaccaauuguuugg

SEQ ID NO: 921 - RNA, 20 nt, Oryza sativa
ucgccgcucagccuagacga

SEQ ID NO: 922 - RNA, 21 nt, Oryza sativa
uccauuucaaaauauaaggca

SEQ ID NO: 923 - RNA, 21 nt, Oryza sativa
uguccaaaacaucugauguga

SEQ ID NO: 924 - RNA, 21 nt, Oryza sativa
ugccccaucgacaccggcgcc

SEQ ID NO: 925 - RNA, 20 nt, Oryza sativa
uccucaccgccucccccucc

SEQ ID NO: 926 - RNA, 20 nt, Oryza sativa
uuguggcucgacaaagauga

SEQ ID NO: 927 - RNA, 20 nt, Oryza sativa
uugguggacguauuuuguug

SEQ ID NO: 928 - RNA, 21 nt, Oryza sativa
uguaugccgcuugauauggga

SEQ ID NO: 929 - RNA, 21 nt, Oryza sativa
uagaguaaaaguguucuaggc

SEQ ID NO: 930 - RNA, 20 nt, Oryza sativa
ugcagagcagucgcgcuuga

SEQ ID NO: 931 - RNA, 21 nt, Oryza sativa
uguagcccucgacgugaccua

SEQ ID NO: 932 - RNA, 21 nt, Oryza sativa
uugcaggcuuccgacgcgucu

SEQ ID NO: 933 - RNA, 20 nt, Oryza sativa
uuaggaugaggcaugugugg

SEQ ID NO: 934 - RNA, 21 nt, Oryza sativa
uggaccuagauggcacauccc

SEQ ID NO: 935 - RNA, 21 nt, Oryza sativa
uccugucagcaucgaucgcca

SEQ ID NO: 936 - RNA, 21 nt, Oryza sativa
uacuagguugcuauauuaugg

SEQ ID NO: 937 - RNA, 20 nt, Oryza sativa
ucuccccccuccgccgccgc

SEQ ID NO: 938 - RNA, 20 nt, Oryza sativa
uggcuaugguugguaagggc

SEQ ID NO: 939 - RNA, 19 nt, Oryza sativa
gacggcggcggcggugagg

SEQ ID NO: 940 - RNA, 20 nt, Oryza sativa
uaauuggauguagcucugau

SEQ ID NO: 941 - RNA, 20 nt, Oryza sativa
uuagggcauccacaaugugc

SEQ ID NO: 942 - RNA, 20 nt, Oryza sativa
ucgucgccgucgucgcaccg

SEQ ID NO: 943 - RNA, 21 nt, Oryza sativa
ggcggcgguagcggcggcggc

SEQ ID NO: 944 - RNA, 21 nt, Oryza sativa
uuuugcugcccuuguuuugca

SEQ ID NO: 945 - RNA, 20 nt, Oryza sativa
ugacgcgaggaugaucggag

SEQ ID NO: 946 - RNA, 21 nt, Oryza sativa
ucuugucagguugcaggauga

SEQ ID NO: 947 - RNA, 20 nt, Oryza sativa
uccuaauuuaaaaaggcugc

SEQ ID NO: 948 - RNA, 21 nt, Oryza sativa
ucguguccaacuuugaucguc

SEQ ID NO: 949 - RNA, 21 nt, Oryza sativa
uucgcccaaaggguacuguga

SEQ ID NO: 950 - RNA, 21 nt, Oryza sativa
uccuacgugacgcugaugugg

SEQ ID NO: 951 - RNA, 21 nt, Oryza sativa
ucgcccucccccggcccuguc

SEQ ID NO: 952 - RNA, 19 nt, Oryza sativa
uauuacucccuccguccuu

SEQ ID NO: 953 - RNA, 20 nt, Oryza sativa
uagguuuguuuauuuuggga

SEQ ID NO: 954 - RNA, 21 nt, Oryza sativa
ucgcgcucguugaucucguac

SEQ ID NO: 955 - RNA, 20 nt, Oryza sativa
ugggggauugcauacugugu

SEQ ID NO: 956 - RNA, 20 nt, Oryza sativa
uccaggcaaggguggacgug

SEQ ID NO: 957 - RNA, 21 nt, Oryza sativa
ugguaggcgaggaccggcggc

SEQ ID NO: 958 - RNA, 21 nt, Oryza sativa
uggcgacuuaagagcauuuau

SEQ ID NO: 959 - RNA, 21 nt, Oryza sativa
uuguagaucugaacaagugua

SEQ ID NO: 960 - RNA, 21 nt, Oryza sativa
ucgcucgaccacaccuccggc

SEQ ID NO: 961 - RNA, 21 nt, Oryza sativa
uucagucagauugcugguguu

SEQ ID NO: 962 - RNA, 21 nt, Oryza sativa
uccagucgauggcuguggucc

SEQ ID NO: 963 - RNA, 20 nt, Oryza sativa
ucggugcagcguggcagccg

SEQ ID NO: 964 - RNA, 21 nt, Oryza sativa
uggacgucuuaacauggccgc

SEQ ID NO: 965 - RNA, 20 nt, Oryza sativa
ugaguauguuuaguuaucua

SEQ ID NO: 966 - RNA, 20 nt, Oryza sativa
uggauuugauguuuucuagu

SEQ ID NO: 967 - RNA, 21 nt, Oryza sativa
uuuagauguggacccuguuuu

SEQ ID NO: 968 - RNA, 21 nt, Oryza sativa
uaugaaguauauguccuauuc

SEQ ID NO: 969 - RNA, 21 nt, Oryza sativa
uguguuuauuugucaaggccc

SEQ ID NO: 970 - RNA, 20 nt, Oryza sativa
uugauugacauguaugccaa

SEQ ID NO: 971 - RNA, 21 nt, Oryza sativa
uugcauccucugcacuuuggg

SEQ ID NO: 972 - RNA, 21 nt, Oryza sativa
uaagagauccgccuaaaaaaa

SEQ ID NO: 973 - RNA, 23 nt, Oryza sativa
cgcuccucgucaaugguugucag

SEQ ID NO: 974 - RNA, 20 nt, Oryza sativa
ugcaagauauguuacgugac

SEQ ID NO: 975 - RNA, 21 nt, Oryza sativa
ugugcaugcgguugcguuguc

SEQ ID NO: 976 - RNA, 20 nt, Oryza sativa
ugucgcagacaacucaaccg

SEQ ID NO: 977 - RNA, 21 nt, Oryza sativa
ucaaguccgugucggcauggc

SEQ ID NO: 978 - RNA, 21 nt, Oryza sativa
uagguacgucgaggugcgcgc

SEQ ID NO: 979 - RNA, 20 nt, Oryza sativa
uugugguccaauaugacggc

SEQ ID NO: 980 - RNA, 21 nt, Oryza sativa
uacuagaauacgucacaucca

SEQ ID NO: 981 - RNA, 21 nt, Oryza sativa
uguccccccgccaaccgccuc

SEQ ID NO: 982 - RNA, 21 nt, Oryza sativa
ugcggcugcuuaagauggcca

SEQ ID NO: 983 - RNA, 20 nt, Oryza sativa
ucccaucauacgcacugcaa

SEQ ID NO: 984 - RNA, 21 nt, Oryza sativa
uacacauggacaucauaccuc

SEQ ID NO: 985 - RNA, 20 nt, Oryza sativa
ggcggugacggugacggugg

SEQ ID NO: 986 - RNA, 20 nt, Oryza sativa
uauucuggucaaaaaacauc

SEQ ID NO: 987 - RNA, 21 nt, Oryza sativa
ucgaguucaucacacaugggc

SEQ ID NO: 988 - RNA, 20 nt, Oryza sativa
uggcuuggcgauagcaacau

SEQ ID NO: 989 - RNA, 20 nt, Oryza sativa
ugagaaguaugugcuccugc

SEQ ID NO: 990 - RNA, 20 nt, Oryza sativa
uugcaggauaugaaugaggc

SEQ ID NO: 991 - RNA, 21 nt, Oryza sativa
ucucucgugccccguagcgcc

SEQ ID NO: 992 - RNA, 21 nt, Oryza sativa
ugaaccagaaccaccgugucc

SEQ ID NO: 993 - RNA, 24 nt, Oryza sativa
gagccgagucgagucgagccgagc

SEQ ID NO: 994 - RNA, 21 nt, Oryza sativa
ugagugaggcaacuugaggua

SEQ ID NO: 995 - RNA, 21 nt, Oryza sativa
ucaaguaacggggugcgugua

SEQ ID NO: 996 - RNA, 21 nt, Oryza sativa
uuccccaucaccaacucccuc

SEQ ID NO: 997 - RNA, 21 nt, Oryza sativa
cggccgugggggagguucgcg

SEQ ID NO: 998 - RNA, 21 nt, Oryza sativa
ugcgccggucgugucauccac

SEQ ID NO: 999 - RNA, 21 nt, Oryza sativa
uucuuacgaacacaacggugu

SEQ ID NO: 1000 - RNA, 21 nt, Oryza sativa
uaagcuucacggguuagccgc

SEQ ID NO: 1001 - RNA, 24 nt, Oryza sativa
aggggagagagagagaggagagag

SEQ ID NO: 1002 - RNA, 20 nt, Oryza sativa
uccaaaauuugguagugcca

SEQ ID NO: 1003 - RNA, 21 nt, Oryza sativa
uccauuguggauguagaggcc

SEQ ID NO: 1004 - RNA, 21 nt, Oryza sativa
ugcgguguggacugaggugag

SEQ ID NO: 1005 - RNA, 21 nt, Oryza sativa
ugaggugauuugauuguguuu

SEQ ID NO: 1006 - RNA, 20 nt, Oryza sativa
uauguaaauuacuuuuagau

SEQ ID NO: 1007 - RNA, 21 nt, Oryza sativa
uaugcuugaauguuuggauga

SEQ ID NO: 1008 - RNA, 21 nt, Oryza sativa
ucgacgugaccuacaacuuug

SEQ ID NO: 1009 - RNA, 19 nt, Oryza sativa
gcauacucccucuguccca

SEQ ID NO: 1010 - RNA, 21 nt, Oryza sativa
ucucauugcuugcaugucauc

SEQ ID NO: 1011 - RNA, 21 nt, Oryza sativa
uaaaguuuguauacguguaug

SEQ ID NO: 1012 - RNA, 21 nt, Oryza sativa
uagaaagugcccucgugugga

SEQ ID NO: 1013 - RNA, 24 nt, Oryza sativa
aggucagggcucucccuacauacg

SEQ ID NO: 1014 - RNA, 21 nt, Oryza sativa
uguaaaauucauucguuccaa

SEQ ID NO: 1015 - RNA, 21 nt, Oryza sativa
uucuacuggucgugugacuca

SEQ ID NO: 1016 - RNA, 21 nt, Oryza sativa
uaacacagaugacauuugguu

SEQ ID NO: 1017 - RNA, 21 nt, Oryza sativa
uaaaaauaugguaauuagcug

SEQ ID NO: 1018 - RNA, 21 nt, Oryza sativa
ugauucugggagaagcugcag

SEQ ID NO: 1019 - RNA, 21 nt, Oryza sativa
ugcgccagugucgagucacag

SEQ ID NO: 1020 - RNA, 21 nt, Oryza sativa
uuuguaaacaguguaacuauc

SEQ ID NO: 1021 - RNA, 20 nt, Oryza sativa
uaugguacuagaucugguac

SEQ ID NO: 1022 - RNA, 20 nt, Oryza sativa
ugggaacccggcauaggugc

SEQ ID NO: 1023 - RNA, 21 nt, Oryza sativa
ugccugaagcgcgagagcggc

SEQ ID NO: 1024 - RNA, 21 nt, Oryza sativa
ucggccaagcacuuuugcuga

SEQ ID NO: 1025 - RNA, 20 nt, Oryza sativa
uuuuuuuaugguacgaaggg

SEQ ID NO: 1026 - RNA, 21 nt, Oryza sativa
uguaguuaagugccagguguc

SEQ ID NO: 1027 - RNA, 21 nt, Oryza sativa
ugagauggaucuagguaaggc

SEQ ID NO: 1028 - RNA, 21 nt, Oryza sativa
ucgagauacuuuuuguuggac

SEQ ID NO: 1029 - RNA, 20 nt, Oryza sativa
ccaccugcccgcucugccgc

SEQ ID NO: 1030 - RNA, 21 nt, Oryza sativa
ucacccccucuuccuucuucc

SEQ ID NO: 1031 - RNA, 21 nt, Oryza sativa
ugccgagagacaaguggauuc

SEQ ID NO: 1032 - RNA, 20 nt, Oryza sativa
uguuagucgggcugacccac

SEQ ID NO: 1033 - RNA, 21 nt, Oryza sativa
uaucguauccuagguugguuu

SEQ ID NO: 1034 - RNA, 24 nt, Oryza sativa
acgagguugguuuauuuugggacg

SEQ ID NO: 1035 - RNA, 21 nt, Oryza sativa
uagcgccggucagaccgccug

SEQ ID NO: 1036 - RNA, 90 nt, Zea mays
uacuccucauuguacggcuccucuuggaccaccuguucaacuccugugggagguuuauauaucgcaagggugagcucacaaaagaucaua

SEQ ID NO: 1037 - RNA, 119 nt, Zea mays
guuuggaucccugucuaaagcuccacaauuugccuaagguuagucccuugaauugaagaacuaagcuuagacagaaaaguuaggcaaguuguggcgccuuaggcaggaaaccaaaacgc

SEQ ID NO: 1038 - RNA, 130 nt, Zea mays
uagggccuguucgguuguaccggaaugagccaggauucauuccagcucaucaaaaucuauauaaauuagagaaguaauccggcuaggaauuaauccggggcuccaauccggaacaaccgaacagggccuu

SEQ ID NO: 1039 - RNA, 85 nt, Zea mays
ucccuuuuagggccuguuuggcauggcuccagagcaaaacuccaagggggagcuggccagagcaugucaaauacccuaauucuag

SEQ ID NO: 1040 - RNA, 78 nt, Zea mays
ccucauuuacuugcaucauaucgauaagaucgccauacugcuuguaugcgucuugucgauaguugcgggcagauugaa

SEQ ID NO: 1041 - RNA, 117 nt, Zea mays
uaaguggagaauuccaaagggauugcacugacugaucugcuuguccucgggcacguacguacgucggcgucgaucggcagguuagaucaaugcgaucccuuuggaguccuccacuag

SEQ ID NO: 1042 - RNA, 106 nt, Zea mays
ucgggcgacucgugacugccugucccaucugggcauggccuugagcgagucaugauugcgucucaugcccaaagguggccucgggcgagucgugacugcgucuccu

SEQ ID NO: 1043 - RNA, 65 nt, Zea mays
ccgugacugagagauccagcgagccagcgcggagucgcggcugguacgcgggucccacgcgacag

SEQ ID NO: 1044 - RNA, 137 nt, Zea mays
  misc_feature (116)..(116): n is a, c, g, or u
auaauuucuaggugaaugcucgugcguugcaacggaaacauauaucacgauaacuuauaacaguauaacucauuuguacauaaguuaucaugauaaauguucuucuugcaacgcanaagcacucaucuagucgcaaa

SEQ ID NO: 1045 - RNA, 163 nt, Zea mays
caaacuucuaaucugggccacaugauguugauccaagggacauagggacguggauaauuuuacacauaaccacccgcugcuaaucacauuuuuucaaaucccccucccacucuccccgcacacccccuuggaucaacaucaugugguucagauuaaaaguuug

SEQ ID NO: 1046 - RNA, 103 nt, Zea mays
ggugccaaaguuuagcacuucacuuuuagcaccuuuuagcacucuuguuugaaucuccaaguacuaaaguuuagcuaaaaguguagugcuaaauuuuagcacc

SEQ ID NO: 1047 - RNA, 127 nt, Zea mays
ucacuggcgaucgacugaggacgauucuugguggcugaguucuugacuacccuauggagcuugcgguggcuucaauuuauagggagagacagcgguggccgggaauuucaguggugaugcgcggcgg

SEQ ID NO: 1048 - RNA, 104 nt, Zea mays
guccaguuucagggcuucucuuucuuggcagggaagcaugagaugccauagcucucugcucucuucaacccucugccaaaggagaguugcccuguaacaggacu

SEQ ID NO: 1049 - RNA, 84 nt, Zea mays
uaauguaaauuggaugguuuuucuuuggcauauuauauuuguuuccaaauguuuguugccacagaugccguccaagacccgauc

SEQ ID NO: 1050 - RNA, 92 nt, Zea mays
accgguaguuuuuucggguaaaguccuauaauuuaauuuaagacaccaccgauuugaguuacguaugcggguucuuccggaacguuuuggag

SEQ ID NO: 1051 - RNA, 95 nt, Zea mays
ugugcuuguucauuaaucuguggcuuauaaaaugugguuacauaugaauauguggcucuuguuugugugcaugcagaugugugacccugcugcac

SEQ ID NO: 1052 - RNA, 91 nt, Zea mays
caauggucaaagccgucggacauaagccucaaaccgucaaacauaguuuauuuccaucgacauuugcuuaucuccgaugguaacuagccgu

SEQ ID NO: 1053 - RNA, 117 nt, Zea mays
cguuugaggaugauaggccgaacuguggaguaauuuagugcccaaaguuuugugcaucucuucccaaaacuuggauacaaauugcgguccccgguccgacacuaucgucuuuggaac

SEQ ID NO: 1054 - RNA, 68 nt, Zea mays
aacauauguggggugagguggacgagccucuggucaaugaucaauggccacacaacccccauuuuuuu

SEQ ID NO: 1055 - RNA, 66 nt, Zea mays
uuuuaucccuuguaaccgaacaaggccuaacguggagcaagguuuugguuugguuguuggaaaaga

SEQ ID NO: 1056 - RNA, 143 nt, Zea mays
aggugguugcucguuggcgggcgcgacugggaagucagaccgaaugggcuucgccuggggacggaucgcgggaguggagggggcuucguaccugggcagggggccuuugggaccgccaggacgccggccgggggcugcugcac

SEQ ID NO: 1057 - RNA, 128 nt, Zea mays
aaacacccucuuagugcauucaaacauccccuaauaguuaaacuaauaucuacuuuuagcuaauaguauuagccaagcauuuguuagcacuaacuuuuuagggguguuugaauguacuagagcuaaua

SEQ ID NO: 1058 - RNA, 236 nt, Zea mays
acgacuguuauguaagcaguccuucuguacaaccguacaaguaaaccaucugauccauuagauuacgauccaaccacauauauaaucaugguuuguuaggaguuuuuuauaaagauuauugaucuagugguggaagaguuuaaguguuaaauaugccuuacgguuggaucacaaucuaauggaucagaugauuugcuugcacgcuugcacagaaggacugcuugcauagcagucgu

SEQ ID NO: 1059 - RNA, 102 nt, Zea mays
uaugcauacaugcuuggcuccuugcacgccacccacagcauccaaucacaucacggguugggcuacauguguggcauacagggagccaggcaugcacgagcc

SEQ ID NO: 1060 - RNA, 66 nt, Zea mays
aauuucaauuucaauggcaacaaauagcuaaagugugguugaacuuguguuguugaacuugaucug

SEQ ID NO: 1061 - RNA, 57 nt, Zea mays
ggcgccguagccuguggcgccgagguaacacagcucggcgccauaggcuauggcgcc

SEQ ID NO: 1062 - RNA, 105 nt, Zea mays
cuagcauagaccucaauccacauguauugagguggauugugguauaacuuaaauuaauuuauacaucaauccacuucaacacauguggauuggggguagauacua

SEQ ID NO: 1063 - RNA, 64 nt, Zea mays
augugccucauccugugguacuuguucuugaccuaggggaugugaguacaagggugagcucaca

SEQ ID NO: 1064 - RNA, 229 nt, Zea mays
augacgguuguguaagcaguccuucuguguaagcaaaccaucugauccauuaaauuacgauccaaccacauauacaaccacgguuuguuaggaguuuuuuuauaaagauuauugagauggugguggaaggguuuaauuauuaaaugugacauacgguuguauuacgaucuaacagaucagaugauuugcuugcacgcuugcacagaaggacugcuugcacaacagucau

SEQ ID NO: 1065 - RNA, 95 nt, Zea mays
uuuaucuaaucuaaguugagcagguucaaacuuguucagcuguaaauaaaagcggcugaaccaguuugcaccagugcaacuugaauuuaacacua

SEQ ID NO: 1066 - RNA, 103 nt, Zea mays
gagcuguuggggggaaugaagccugguccgagaccguccgacgaccgagagagcacgucgucugguacggucucgcgccagacgacauuccccucaacaagac

SEQ ID NO: 1067 - RNA, 197 nt, Zea mays
aggaccacgcuggagaagcagggcacgugcaugcacauacgccauucucgaucucuccucuccaccacuacugcaucuagcuaucuccauggauggauguacguagcucggacuggaucgaucggagaagcaauaagcuagcgagcucaugcaugcuggcugugcacgcacguggucuccuucuccaucacgguucu

SEQ ID NO: 1068 - RNA, 123 nt, Zea mays
gggaucgauaugccuggcucccuguaugccacucgcauggcugccaacucaucaugcauacacugcuagcuagucguuggcuccacugcggauggcgugcguggagccaagcaugaccgauca

SEQ ID NO: 1069 - RNA, 83 nt, Zea mays
ggcuggucuggacagcaagccccgugcgugacgcugcggccucggcgaugaaguuaugcguggagccaguguccagaagggcg

SEQ ID NO: 1070 - RNA, 93 nt, Zea mays
uaaugucaaauucaaguugcacuggugcaaaccgguucaguugauuuuguuuacaacugaacaaguuugaaccuggucaacuuagauuagaua

SEQ ID NO: 1071 - RNA, 122 nt, Zea mays
gcguuuugguuuccugccuaaggcgccacaacuugccuaacuuuucugucuaagcuuaguucuucaauucaagggacuaaccuuaggcaaauuguggagcuuuagacagggauccaaacaug

SEQ ID NO: 1072 - RNA, 145 nt, Zea mays
ccucuucagggaugauuuggugaucggggauccugaggggauccauggggagaaauucucuugcuauucaaaauugaauugcaaggguauuccuccccauggauccccucgggaucccuaaucaccaaaucagccaucaauguug

SEQ ID NO: 1073 - RNA, 171 nt, Zea mays
agggcuuuacacaggaaaaaccacuccaacagugccucaauucaacaaauuuugucaaaaaauuauagggcacccucucaagugccucaaauauacuacaccguagugggcugcccuauaaucuagauuuggggcuuuacuguuggagcgggguguuuuguuggugcccua

SEQ ID NO: 1074 - RNA, 108 nt, Zea mays
agugggacgugauauuggcacggcucaaucagagagcagagccccacccccccuggccucugcuagggcucgagcucucgaauugaaccgcgucaauaccccgucuag

SEQ ID NO: 1075 - RNA, 103 nt, Zea mays
cuagcauugaccucaauccacauguauugagguggauuaugguguaaauuaguuaaguuacacccuaauccaccucaauacauguagauugagaucaauacua

SEQ ID NO: 1076 - RNA, 161 nt, Zea mays
gcagcucucuugguucguuagaucuagauccagccgcauguaugaucgugguuuguuagguuuuuuuuuuauaaagcuacacuaggugguagugggaggauuuuaaaugcuaaauauaguauuacgguuagaucuagaucuaacggaccaaaagacugacu

SEQ ID NO: 1077 - RNA, 102 nt, Zea mays
  misc_feature (99)..(99): n is a, c, g, or u
ugcgaaucacagugcagcucuccucuggcaugaaggcugugagagaggcaugacaauuucuggccuugcccugccaaaggagagcuguccugccauucnaua

SEQ ID NO: 1078 - RNA, 79 nt, Zea mays
agggaggcagggcagacgagacaggcagagacgaacgcacgcagggacucucucucucucgcucucgcccucgaucucu

SEQ ID NO: 1079 - RNA, 83 nt, Zea mays; identical to SEQ ID NO: 1069

SEQ ID NO: 1080 - RNA, 386 nt, Zea mays
cguagcguccccauccauuuagcgggagagagaagaaaucgggaggggagaggaggaagaggaaggcgguguaggggauagagggccacuguagccccuauccgugcuacaguaauaggggagggggacgcaagcgucccccguugaacacagucuuauuaaaccagaucacaucacgucgcagaugcacagguggugauuuguuuguaggagaggguauuguagaugucguauacaaccuuccauucaauauuauuacauuuuacaauccucuguuuuguauuuacaaugcuacguuuuuccuauuccuauauuuuuuaauuccuacguucaaaaggagccuacuucucgugccaugaccuugcuaggagguaugacaacauaaa

SEQ ID NO: 1081 - RNA, 170 nt, Zea mays
uaggugcaagcgagccuccuggaccuuuagauuaugauccaaucauagauguaguuguagguugucgagaggagggugauaaagcuacgugagcugauggaggguuuaaguguuaaauguggccuacgguuggaucacgaucuaaaggucuaggaggcucacuugcacgc

SEQ ID NO: 1082 - RNA, 177 nt, Zea mays
gagguguuugguuucuagugacuaauauuuagucccuacauuuuuauuccauuuaaguuacaaaauuacuaaauauagaaacaaaaacuuuauuuuaguuucuauauuuugcaauuuauacacuaaaauggaauaaaaugauggacuaaacauuagucccuucuaaccaaacacccc

SEQ ID NO: 1083 - RNA, 161 nt, Zea mays; identical to SEQ ID NO: 1076

SEQ ID NO: 1084 - RNA, 130 nt, Zea mays
aaggcccuguucgguuguuccggauuggagccucggauuaauuccuagucggauuacuucucuaauuuauauagauuuugaugagcuggaauaaauccuggcuuauuccgguacaaccgaacgagcccua

SEQ ID NO: 1085 - RNA, 61 nt, Zea mays
aaugauuuucucacaagucucuaagcaauauaguugauuuuggagcuuggaguggauugaa

SEQ ID NO: 1086 - RNA, 103 nt, Zea mays
aguugugagacauuauguguauaaaccuaagagaacuacacuugaagucauagauuuucaauguggaucucuuagguuuguacacauagcgcguucaacuuuc

SEQ ID NO: 1087 - RNA, 261 nt, Zea mays
agauuuucaaucgaaccauaaaguuuguagcacgguugacaagguaaacuuauuuaaacucauuacauacauuucguauuauaauauuaguuuuuuuauuauaaaucguuuauuauuuuuuuaaugacauugacaugugucgugaaaaaaauaaacgauuuauuauaaaaaguaauaauauaauacaaauuguaaguaaugcguucaaauaauuuuaacuuugcacccgugcugcaagcuuuaugguucgauuggaaucua

SEQ ID NO: 1088 - RNA, 95 nt, Zea mays
ucuaucuaaucuaaguugagcagguucaaacuuguucagcuguaaacaaaaucagcugaaccgguuugcaccagugcaacuugaauuuggcacua

SEQ ID NO: 1089 - RNA, 93 nt, Zea mays
uaugaucuuuugugagcucacccuugcgauauauaaaccccccccuacaggagaagaacauguggcgcaagaggaggucuacggcgaagagua

SEQ ID NO: 1090 - RNA, 123 nt, Zea mays
aacuguuaguuauagugcauucaaacaccccuuauuccguuugacauaguaaaagcaguacacaguucuuccuuuuuuuuccuucuaaaauuaggggguguuugaaugcacuagaacuaauag

SEQ ID NO: 1091 - RNA, 102 nt, Zea mays
cuaguauugaucucaaucuacauguauugagguggauuaggguguaacuuaacuaauuuacaccauaauccaccucaauacauguggauugaggucaaugcu

SEQ ID NO: 1092 - RNA, 83 nt, Zea mays
ggcuggucuggacagcaagccccgugcgugacgcugcagccucggcgaugaaguuaugcguggagccaguguccagaagggcg

SEQ ID NO: 1093 - RNA, 104 nt, Zea mays
gaaacuauaacgcgcuauguguacaaaccuaagagauccacauugaaacucuaugauuucauguguaguucucuuagguuucuacacauagugucucacaacuu

SEQ ID NO: 1094 - RNA, 101 nt, Zea mays
cacugaccugcaaucuaagucauggauggaaucauaaugagcaaaaaucauguuguauugauuaaugugaugaugaaauuagacuagaugcaaacaagguc

SEQ ID NO: 1095 - RNA, 212 nt, Zea mays
ugauucagagguguuugaaugcacuagagcuaauaguuaguggcuaaaauuaguugagacauccaaacacccuagcuaauaguucaacuauuaacuauuuuugguaaauuaguuaauaguuaguuaguuauuuguuagcuagcuaaauccacuaacaauuuuuagcuaacuaacuauuaguuauagugcauucaaacaccccccucaaucuu

SEQ ID NO: 1096 - RNA, 117 nt, Zea mays; identical to SEQ ID NO: 1053

SEQ ID NO: 1097 - RNA, 73 nt, Zea mays
  misc_feature (64)..(64): n is a, c, g, or u
aucaacaauuugaagacaaaauaggcccgggagaauaaccccuagggcuuguucguuuuggagnggauugagg

SEQ ID NO: 1098 - RNA, 271 nt, Zea mays
aaauguuacagcucaugguuacgcuggaggaaaugaacacgauggaaaucauguucugccaaaugauauagauaauucuuagaggcaauauugcaucgucgcaaagauccaucgauguuauucacgagagguauggaggccuugaugaaagcaacaaaagagccuuuguacggugagucuaaggguuuauuguaauuaguuauugauuuuucuuucuaucuguuuaggguuuagguccgcucgccgugaguugcaacgugacccuaauuau

SEQ ID NO: 1099 - RNA, 127 nt, Zea mays
cuagcucaaguucucaacacuacacuaggaucaaaucaccagaacuucaaacggcagaaagccgaaggccaaaagcagaggagacacguagacauguauuuguugucauguugagaacauaauuguu

SEQ ID NO: 1100 - RNA, 165 nt, Zea mays
guaaacugugguuguacauuaauaugugccuuauaaacuauuguuacauaugaauauguggcuuguaaacugugguuguacauuaauaugugccuuauaaacuguuguuacauaugaauauguggcuguuguuugugugcaugcagaugugugacccugcugcac

SEQ ID NO: 1101 - RNA, 77 nt, Zea mays
ugaaaaaagagauguauaccacgcgcuguccuugcaaucaaaagacugacauguugguguugcugucucacccuguc

SEQ ID NO: 1102 - RNA, 200 nt, Zea mays
aucacucauuuggugcaagugugcaaucaaacuauccagaacaucuaaucuagauucaaugguuucauauggaagggguuaaaaguaaaauagguacuagguuucaaguggaagggguuaccuguaaaguaacauucaucauuggaucuagauuggauacaccggauugauugauugcaugcuugcaccaauauaaauga

SEQ ID NO: 1103 - RNA, 153 nt, Zea mays
gcguagugaauagcgaucugaucauugacggaaggcaguugugauuugaguguuaagaauuugcgguaauacucccgcagagucuccuuuuccagcuguuugcaaagcgagagcucggccaaagcgucggugucuagacgguacccuuggaag

SEQ ID NO: 1104 - RNA, 170 nt, Zea mays
ggggagagcuugggcccuguacaugugauggcguggccgccggaggagcgccugaguccuguaggagcacagcugguagcgcggcgaggauccugcugacgucuccuugcugucguaaggggcugagagccaccaacgucauggagcacgcggggcaccaucauuacccg

SEQ ID NO: 1105 - RNA, 84 nt, Zea mays
uaauguaaauuggaugguuuuucuuuggcauauuauauuuguuuccaaauguuuguugccucagaugccguccaagaccugauc

SEQ ID NO: 1106 - RNA, 94 nt, Zea mays
caaagggaauggaagaggcaggcacuggagagcuaacgaggggccaaccacaccucguucgugcuccucugcaugccccuuccaccgcugcugc

SEQ ID NO: 1107 - RNA, 215 nt, Zea mays
agaguaucaggggguguuugaaugcacuauaacuaauaguuaguuagcuaaaaaauguuaguggaauuagcuaucuaauaaauaacuacauaacuauuaauuaauuuaccaaaaauagcuaauaauugaacuaucagcuauaguguucggacgucucaacuaauuuuagccacuaaauauuaguuuuaguucauucaaacaccccucagaccaug

SEQ ID NO: 1108 - RNA, 64 nt, Zea mays
ucuaaauuuucugccuaagguuaguucuucaauucgaacgacuaaccuuaggcaaaguguggca

SEQ ID NO: 1109 - RNA, 113 nt, Zea mays
ggcgguuccuuaagaaaaccgucacuagaaaucauauuucuacaggcgguuccuuaagaaaacagccuguaaaaauccaugauuucuaguggcgguuuucuuaaggagcggcc

SEQ ID NO: 1110 - RNA, 123 nt, Zea mays
gcgagagagugaagcugcaacaugaucuggugaauccaagcgucaccgacgaucgagcgagcacucgagacgcccgccggcgucugagcagccagaucaugcuggcagcuucaaccucucaca

SEQ ID NO: 1111 - RNA, 113 nt, Zea mays
ggcgguuuauuaagaaaaccgccacuagaaaucguauuuuuagaggcgguuccuuaugaaaaccgucuguagaaauccaugauuuuuaguggcgguuuucuuaaggaaccgcc

SEQ ID NO: 1112 - RNA, 157 nt, Zea mays
auaccacuaagggcuuguucgguuagcucucaauccauguggauugagugggauuggauggguuugaaucccaaacaagucaaacuucuuaagaaauuuuuccaaucccauccaauccauguguauugggaauaaccgaacaaggccuaaguuguua

SEQ ID NO: 1113 - RNA, 95 nt, Zea mays
aaugucaaauuucaaguugcacuggugcaaacugguucagcugguauuauucccaacugaacaaguuugagccugcucaacuuagauuagauaaa

SEQ ID NO: 1114 - RNA, 87 nt, Zea mays
uugcaucuaagucugggugguguaguugguuaucacguuagucucacacacuaaagguccccaguucgaaccugggcucagacauuu

SEQ ID NO: 1115 - RNA, 197 nt, Zea mays
acaagccguggagcucaggauagauagcgcuucagauugauagacagaaccacgccuccagaggagaacacaaaagcuagccaagauccauguagauuauucaucacacauaucucuuggcucuuucuuucuccucgcggccggcuccgaucuauguguuuuccuaggcgcuaucccuccugagcuucaaggguugu

SEQ ID NO: 1116 - RNA, 123 nt, Zea mays
cuuguucgguugcgucuggaucgaaggagauuggaggggauuaaaucccuuuucuaguaaaaauugaauagcaugggauuuaaucucccucaauccccuucaauccagacgcacccaaacaag

SEQ ID NO: 1117 - RNA, 121 nt, Zea mays
ucaucuuaauuaggggguauuuguuugagauuauaaucugcccacuuaguucaaaaaauuguuagauuauauaaucuugacagauuauuuuuccaaacaaacaccuccuuaguuucgagag

SEQ ID NO: 1118 - RNA, 131 nt, Zea mays
agggcuaguuugggagucacaaaacuggagagaauuagagaggcuaaaauuauucucuuauucaaaguugaauaaggaggggauuuagucccuccaaucuucuucgguauuugaacuuucaaacuaguccu

SEQ ID NO: 1119 - RNA, 172 nt, Zea mays
gguguuugguuuauagggacuaaacuuuagucccuacacuuuauuccauuuuaauucauaaauuguuaaauauggaaacuaaaauagaguuuuaguuucuauauuuaguaauuuagggacuaaaauagaauaaauugagggacuaaacauuagucccuagaaaccaaacacc

SEQ ID NO: 1120 - RNA, 177 nt, Zea mays
aggauguuugguuucuagugacuaauauuuagucccuacauuuuauuuuauuuaagucacaaaauugucaaauauagaaacuaaaacuuuauuuuaguuucuauauuugacaauuuauacacuaaaauagaauaaaaugaugggacuaaacauuagucccuagaaaccaaacaccca

SEQ ID NO: 1121 - RNA, 102 nt, Zea mays
cuaguauucaccucaauccacauguauugagguuaauugggguguaaauuaaacuuuacaccccaauccaucucaauacauguggauucuggugaauacuag

SEQ ID NO: 1122 - RNA, 135 nt, Zea mays
uagagcugauuugguggacagggaauugaaggggauccaugugggaggaauccccucccuauucaaauuuaaauaagaagggaauuacucccccauggauccccuccaauuccaugugcaccaaaccagcccuua

SEQ ID NO: 1123 - RNA, 270 nt, Zea mays
acaacagagaacauaucuaaugcacaugaaagauugaugcacaugaugcacauauuaaaucaucaccacuuauuuuagauuuaacgucucuaguuguuugguauauuuugcuaaaaacaucauccaacguggugguguguaguagugaaauguguuauuuguaaauugaaugaucaacuagagacguuaaaucuaaaaugaguggugguaauuuaauauguacaucauguacaccaaucuucuaugugcacuagauauguccucaugaca

SEQ ID NO: 1124 - RNA, 60 nt, Zea mays
cgucgaacuccccgccggcgagcgcuuuccugugagggcgccgccgucggugagauccuc

SEQ ID NO: 1125 - RNA, 100 nt, Zea mays
uaugaccugcuuauggauuaucauaaucuagguaucauaaucuagauuauuuaagcuagauuaugauaccuagauuaugacaauccaugagcaggucaau

SEQ ID NO: 1126 - RNA, 95 nt, Zea mays
ccucuccccuugcacuguauacgcguagggggccucuacgcccgcagcggcggccuccaaauggcccccuacgcacugcagcgcaaggggacgcc

SEQ ID NO: 1127 - RNA, 130 nt, Zea mays
uaggcccuguucgguuguuccggauuggagccccggauuaauuccuagccggauuacuucucuaauuuauauagauuuugacgagcuagaaugaauccuggcucguuccgguacaaccgaacagacccuu

SEQ ID NO: 1128 - RNA, 229 nt, Zea mays
acgacugcuauguaagcaguccuucugugcaagcgugcaagcaaaucaucugauacauuagauuacgauccaaucacagauacaaccaugguuuguuaaggauuuuuuuauaaagauuauugagcugcugguggaaggguuuaaguguuaaauaugaccuacgguuggaucacgaucuaauggaucagauggauugcuugcacagaaggacugcuugcauagcagucgu

SEQ ID NO: 1129 - RNA, 156 nt, Zea mays
aguuccggcgggggcgaacugagaacacaugagaauaaugagaugagauugcucgccucgcgguacgguucgugcuggccuggaccaccgucgucgccguucaucuuguacgcauaauaaugcugcauguguucucaggucgcccccgcagggccu

SEQ ID NO: 1130 - RNA, 157 nt, Zea mays
ugccauuuuaggccuuguucgguuauucccaauacacauggauuggaugggauuggaaaaaauucuuaagaaguuugacuuguuugggauucaaacccauccaaucccacucaauccauauagauugagagcuaaccgaacaagcccuuaguaauaa

SEQ ID NO: 1131 - RNA, 137 nt, Zea mays
cgauagguaucuugauucagcuauugccgcuggucgcuuagcuagguccauuugacccucacuuauugcaauauuuugcauaaaacuauuuuagauuacaggauccguuguagucuagcuggucaggauauucggcu

SEQ ID NO: 1132 - RNA, 175 nt, Zea mays
auaagaggguguuugaaugcacuagagcugauaguuaguagcuaaaauuaguuggagacauccaaacaccauagcuaauaguucaacuauuagcuauucguuaguuagcuaauuucacuaguaauuuuuuagccagcuaaauauuagcucuagugcauucaaacaacaccuuagu

SEQ ID NO: 1133 - RNA, 130 nt, Zea mays
uaggcccuguucgguuguuccggauuggagccccggauuaauucuuagccggauuacuucucuaauuuauauagauuuugaugagcugaaauaaauccuggcucauuccgguacaaccgaacgggcccuu

SEQ ID NO: 1134 - RNA, 130 nt, Zea mays
cucauauucaccucaauccacauguauugagcuagauuggauuguaacuuaaacuaauuuacacaccaauuaaucucaauacauguuacacucuaauucaccucaauacaugugaauugaagugaauacg

SEQ ID NO: 1135 - RNA, 105 nt, Zea mays
ugucuugcuguggcuguugccgccgcugcuaugaucuagcugccgcucguggugggcuguacagggcggcguugggagcggcgguggcgacaugacaggggaaau

SEQ ID NO: 1136 - RNA, 118 nt, Zea mays
ggagggagcgauauuggcgagguucaaucagaugauguauuuuucuuauauauaaauuugcaugcaugaaggugugaauccagugucugauugagccgcgccaauaucacuuccuucc

SEQ ID NO: 1137 - RNA, 149 nt, Zea mays
auaaaaaugauuucuaguggcgguuuucuuaauaaaccgucacuacaaaucauggauuuuuauaggcgauuuuguuaaaaaaccgccuguagaaauaaugauuuuuagugacgguuuuuuaaaaaaccaccacuaaaaauaguacauac

SEQ ID NO: 1138 - RNA, 82 nt, Zea mays
cuucuucuguugcgucuggaucgaaggagauugaugauuuaauccccuccaaucuccuucaauucagacgcaaucgaacaag

SEQ ID NO: 1139 - RNA, 170 nt, Zea mays
gcuaagaagguguuugaaugcacuagagcaacuaauaguuaguugacugaaaaauuguuagugaaauuagcuaguaacuagcuauuagcuaauaguugaacuauuaguuagacuauuuugaugucuucaacuaauuguauagcucuagugcauucaaacaccccuaaauc

SEQ ID NO: 1140 - RNA, 162 nt, Zea mays
acugugcaaguaaaccaucugguccauuagauugugauccaacguaggucacauuuaacacuuaaacccuuccacuaccagcucaauaaucuuuauaacaaaccaugauuguauaugugguuggaucguaaucuaauggaccagaugguuugcuuauacguu

SEQ ID NO: 1141 - RNA, 100 nt, Zea mays
cuuucaauuuuggcacggcaaagaacucgcacuggacgcuguaaucgaccgccgauuagagcaccccggugcgaguuuuuugucgugccaaauuaaacaa

SEQ ID NO: 1142 - RNA, 105 nt, Zea mays
cuaguauugaccucaauccacauguauugagguguauuaugguguaauuuaaacuaaauuauaccccaauccgccucaauacauguagauuaaggucaauacuag

SEQ ID NO: 1143 - RNA, 94 nt, Zea mays
gacaaggggaucccgggaggauugaaggggauuaagggggaaaucaacuaauuuccuucucaauccccuccgauccuccugggaucccggguca

SEQ ID NO: 1144 - RNA, 157 nt, Zea mays
acccaaauaaggccuuguucgguuauucccaauacacauggauuggaugggauuggaaaaaauucuuaagaaguuugacuuguuugggauucaaacucauccaaucccacuuaauccacauggauugagagcuaaccgaacaagcccuaauugaguu

SEQ ID NO: 1145 - RNA, 156 nt, Zea mays
aauucuguuaggccuuguucgguuauucccaauacauauggauugaaugggauuagaaaaaauuuuuaagaaguuugacuuauuugggauucaaacucauucaaucccacucaauccacauggauugagagcuaaccgaacaagccauuaaugggc

SEQ ID NO: 1146 - RNA, 122 nt, Zea mays
ucuguuuaguuuccugccuaaggcgccacaaucugccuaacuuuaggcgcucgaauuggagaacuaagcuuagacagaaaaguuaggcacguuguggcccuuuagucagcaaaccaaacagc

SEQ ID NO: 1147 - RNA, 130 nt, Zea mays
aagggcuuguucgguuguaccggaaugagccaggauucauuccagcucaucaaaaucuauauaaauuagagaaguaauccggcuagaaauuaauccggggcuccaauccggaacaaccgaacagggccua

SEQ ID NO: 1148 - RNA, 122 nt, Zea mays
ccuguuugguuuccugccuaaggcgccacaacuugccuaagcuuagucgcucgaauugaaaaacuaaccuuagacagaaaaguuauucaaguugugacgcuuuaagcaggaaaccaaacuaa

SEQ ID NO: 1149 - RNA, 110 nt, Zea mays
ggcauaaagcuucgguacuguaaacgacaagacauggccauuaaaaccuagaaggcaauucuuucuccaaugacuaaguucuggucuuagcgguacugaaggcgacuccu

SEQ ID NO: 1150 - RNA, 140 nt, Zea mays
uuuaaucucuaaagaagcaaauauggugauuaaaguguggugacuaaauuuuaguucuuuagucacuaaaagggugacuaaagaauuaaaguuuagcuaauccacuuuagucaucauguuugcuucuuuauauacuaaaa

SEQ ID NO: 1151 - RNA, 59 nt, Zea mays
uagaaaucgauuucuaguggcgguuuucuuaaagaaccgccacuagaaaucauuuuuau

SEQ ID NO: 1152 - RNA, 107 nt, Zea mays
ucuuguauuuaccuuaauccauguguauugagauauauuaagguguaaauuaauuuaaguuacgccucaauuuagcuuaauucacaugaauuagugugaauacuuga

SEQ ID NO: 1153 - RNA, 124 nt, Zea mays
gcuuguucguuuacaccaauccagagggggauuggagaggauuuaauccccgccuagucauuuuugacuagaaggggauuuaaaccccuccaauccccaucuggauugguguaaccgaacaugc

SEQ ID NO: 1154 - RNA, 92 nt, Zea mays
uagugucaaauucaaguugcacuggugcaaaccgguucaguugauuuuguuuacaacugaacaaguuugaaccugccaacuuagauuagaua

SEQ ID NO: 1155 - RNA, 223 nt, Zea mays
agccauuaagggggcguuugaaugcacuagaacuaauaguuaguggcuaaaauugguugagacauccaaacaccuuagcuaauaguuuagcacuuuagcuauuagcuauuauugguaaauuaguuaauaguuggguaguuauuuguuagcuagcuaauuccacuaacaauuuuuagccaacuaacuauuaguuauagugcauucaaacacccccuaacucuua

SEQ ID NO: 1156 - RNA, 277 nt, Zea mays
uugucuaugguaccauauugaguugcaugcaccaacaaauacaacccaaaauguuaagcugauaggaaaggcgaacaauuucacaauuaaauaaaauaauggugcuugcuccauucuacgucuaagaccagaggaagccuccaugugagggggggggguguuggaguauaagugauuuuguuggaauauaauauaaguggguuguccuccuucuauuagcuuaagcuuuugaauugaacugguuggugcaugcaacuuaauaugguaucagagccag

SEQ ID NO: 1157 - RNA, 93 nt, Zea mays
ggugcuaaaguuuagcacuacacuuuuagcuaaacuuuaguauuuagagauccaaauaggagugcuaaaagugaagugcuaaacuuuaguacc

SEQ ID NO: 1158 - RNA, 106 nt, Zea mays
ucucguauucaccuuaauccauguguauugagguggauuauauuggaacuuaaacuaauuuacaccucaauccacuucaauacaugugauugaggugaauacgaga

SEQ ID NO: 1159 - RNA, 116 nt, Zea mays
uuuugggggugggggugcaaauaaggcaguguuaauuauugauggagagcauuaggauucagaauucaguagccuaguaguuaagacuuccgaguagcaccuccaaggcccgggua

SEQ ID NO: 1160 - RNA, 130 nt, Zea mays
uaggcccuguucgguuguuccggauuggagccccggauuaauuccuagccggauuacuucucuaauuuauauagauuuugaugaucuggaaugaauccugucuuauuccgguauaaccgaacggguccgu

SEQ ID NO: 1161 - RNA, 183 nt, Zea mays
acggauuugcucaauccggacgccgauguggcgugccacguuggagcauacuaaugaaaguuccgagacccagugacacaacaugucaaguuugggacccgagugacacaacaugccaaguucgaggacccaagugacucuaacgugguacgccacgucgguauccgguuugagcaaaaccgg

SEQ ID NO: 1162 - RNA, 215 nt, Zea mays
acgaaacugagggguguuugaaugcacuagaacuaauacuuaguuagcuaaaaauuguuaguauaauuagcuagcuaacaaauaacuaccuaacuauuaacuaauuuacaaaaauagcuaauagcugaaauauuagcuaggguguuuggauguuucaacuaauuuuagucacuaacuauuagcuuuagugcauucaaacauccccugagaagaua

SEQ ID NO: 1163 - RNA, 95 nt, Zea mays
agugucaaauuucaaguugcacuggugcaaacugguucagcugguauuauucccaacugaacagguuugaaccugcucaacuuagauuagauaaa

SEQ ID NO: 1164 - RNA, 86 nt, Zea mays
guugugucugugggugauuguauuucugguaguaacagugauucuuccugaauuuuggauaauacaagcucauucgcaguaguuuc

SEQ ID NO: 1165 - RNA, 177 nt, Zea mays
uggguguuugguuucuagggacuaauguuuagucccaucauuuuauucuauuuuaguguauaaauugucaaauauagaaacuaaaauaaaguuuuaguuucuauauuugacaauuuugugacuuaaauagaauaaaauguagggacuaaauauuagucacuagaaaccaaacacccc

SEQ ID NO: 1166 - RNA, 173 nt, Zea mays
gguguuugguuucuagggacuaauguuuagucccuucauuuuguuccauuuuaguauauaaauugacaaauauagaaacuaaaauagaguuuuaguuucuauauuugauaauuuuguaacuaaaguggaauaaaauguagggacuaaaaauuagucccuacaaaccaaacacc

SEQ ID NO: 1167 - RNA, 87 nt, Zea mays
caacuaacauuagcucuagugcauucaaacacccccuaagccaagcaaguaguuuuguggucugaagcgcuaggguuuaggguuucc

SEQ ID NO: 1168 - RNA, 157 nt, Zea mays
ccacacaugaggccuuguucgguuauucccaguacacauggauugaaugugauugaaaaaaauuuuuaagaaauuugacuuguuugggauuuaaacucauccaaucucauucaauccacaugaauugaaagcuaaccgaacaaggccugagcgaggc

SEQ ID NO: 1169 - RNA, 173 nt, Zea mays
aguguuugguuucuaagaacuaauguuuagucccuucauuuuauaccuuuuuaauauauaaacuguuaaauauagaaauuaaaauaaaguuuuaguuucuauauuugguaauuuuggaaauaaaauaaaauaaaauauagagacuaaacauuagucccuagaaaccaaacauc

SEQ ID NO: 1170 - RNA, 212 nt, Zea mays
aaagugccguucgguuuucacggaacggaggucuggaacaauuccuagcuggauuucuucucuaaauuauauaaguuuugcuuagggccaguucgguuguaccggaaugagccaggauucauuccagcucaucaaaaucuauauaaauuagagaaguaauccggcuaggaauuaauccggggcuccaauccggaacaaccgaacagggccuu

SEQ ID NO: 1171 - RNA, 130 nt, Zea mays
uaggcccuguucgguuguuccggauuggagcaccggauuaauuccuagccggauuacuucucuaauuuauauagauuuugaugagcuagaaugaauccuggcucauuccgguacaaccgaacagacccuu

SEQ ID NO: 1172 - RNA, 99 nt, Zea mays
aacuuuagggacuaaacuuuaguccuuagaaauacuauuuggaagacuuauuuuaagggguguuugguuucuagggacuaauguuuagucccuagauuu

SEQ ID NO: 1173 - RNA, 93 nt, Zea mays
uaucuaauccaaguugagcagguucaaacuuguucagcuguaaacaaaaucagcuaaaccaguuugcaccagugcaacuugaauuuaacauua

SEQ ID NO: 1174 - RNA, 184 nt, Zea mays
aggccggaucggcaucggacagauggauaacagaucgggucuagcuagucguguugcaccuaaggaccagacacgugcccgguggacaauggaccagacaauuguugggcugggcuaaaucgugcugagccacacgagaaguaggacugggcguucgguucuucgguucgguucgguucgguuc

SEQ ID NO: 1175 - RNA, 151 nt, Zea mays
gauguuugguuucuagggacuaauguuuagucccuucauuuuauucuauuuuaguauauaaauaaaauagaguuuuaguuucuauauuugguaauuuuauaacgaaagugggaauaaaauguagggacuaaaaauuagucccuagaaacca

SEQ ID NO: 1176 - RNA, 104 nt, Zea mays
cuacuauagaucccaauccacauguauugagguggauugagguuuaacuuaacuaaguuacaacccaauuuaccucaauacauguggauugaggucaauucuag

SEQ ID NO: 1177 - RNA, 173 nt, Zea mays
gguguuugguuucuagggacuaaucuuuagucccuucauuuuauuccauuuuaguucuuauauugucaaauacggaaacuaaaauagagucuuaguuuccauauuuagcauuuuaaguacuaaaauagaauaaaauguagggacuaaacauuagucccuagaaaccaaacacc

SEQ ID NO: 1178 - RNA, 177 nt, Zea mays
gggguguuugguuagaagggacuaauguuuaguccaucauuuuauuccauuuuaguguauaaauugcaaaauauagaaacuaaaauaaaguuuuuguuucuauauuuaguaauuuuguaacuuaaauggaauaaaaauguagggacuaaauauuagucacuagaaaccaaacaccuc

SEQ ID NO: 1179 - RNA, 66 nt, Zea mays
ugcgguugcuuaaaaaaccaccacuaaaucauagauuucuaguggcgguuuucuuaagcaaucguc

SEQ ID NO: 1180 - RNA, 173 nt, Zea mays
gguguuugguuucuagggacuaauguuuagucccuucauuuuauucuauuuuaguauauaaauugacaaauauagaaaguaaaauagaguuuuaguuucuauauuugauaauuuuguaacuaaaguggaauaaaauguaggaacuaaaaauuagucccuacaaaccaaacacc

SEQ ID NO: 1181 - RNA, 107 nt, Zea mays
ucuaguauucaccgcaauccacguguguugagguuuauuagaguauaaauuaaacuaauuuacaccccaauauaucucaacacaugugaauuagggggaauacuaga

SEQ ID NO: 1182 - RNA, 110 nt, Zea mays
gcgagagagugaagcugcaacaugaucuggugaagcgccaccgaucgagcacuugggaggccggcggcguuugagcagccagaucaugcuggcagcuucaagcucucaca

SEQ ID NO: 1183 - RNA, 144 nt, Zea mays
caaaccagacuguuugcagccucucacaaaaauaaagauagauccuaucuauagauccaccagauaacauuuuaguuguguuauuagccugcagguuagauuuauccuccuuuuugugaggggcugcaaacagccugcuuugca

SEQ ID NO: 1184 - RNA, 156 nt, Zea mays
ggcaguuucuuaagaaaaccgccacuagaaauugauuaauacagucgguuccuuaagaaaacgcuacauaaaucauggauuuuuacagacgguuuucuuaagaaaaccgcuguaaaauacgauuuuuuagugggcgguuuuuuuuaaguaacgaca

SEQ ID NO: 1185 - RNA, 130 nt, Zea mays
uaggcucuguucgguuguuccggauuggagccccggauuaauucuuagccggauuacuucucuaauuuauauagauuuugaugagcuggaaugaauccuggcucauuccgguacaaccgaacaggcccuu

SEQ ID NO: 1186 - RNA, 172 nt, Zea mays
gugguuuaguuucuagggacuaauguuuaguccuuuuauuuuauuccuuuuuaguauauaaauugcuaaauauaaaaacuaaaauaaaguuuuaguuucuauauuuaguaauuuuggaaaaaaaaaaaauaaaauguagggacuaaauauuagucccuaaaaaccaaacacc

SEQ ID NO: 1187 - RNA, 68 nt, Zea mays
ccgucucauuuuaguugucgcuggauagugcaaaauuaaacuauucagcgacaacuaaaaauaaacgg

SEQ ID NO: 1188 - RNA, 228 nt, Zea mays
aacauuuuugggguguuugaaugcacuagagcuauuaguuaguuggcuaaauagaauuagcuagugcauucaaacaauauauuuuugaaacuugcuaguagaauuagcuagcuaacuauuagcuaauuugcuaaaaguagcuagaguguuuggauguauucagcuaauuuuaacauauaauuauuaguucuaucagcuauagugcauucaaacaccccuuuaguuggc

SEQ ID NO: 1189 - RNA, 271 nt, Zea mays; identical to SEQ ID NO: 1098

SEQ ID NO: 1190 - RNA, 130 nt, Zea mays
aaggcccuguucgguuguuccggauuggagccccggauuaauuccuagccggauuacuucucuaauuuauauagauuuugaugagcuggaaugaauccuggcucauuccgguacaaccgaacaggcccua

SEQ ID NO: 1191 - RNA, 105 nt, Zea mays
cuaguauucacccuaauccacauguauugagguggauuguaguguaaauugauuuaauuuacaccccaauccaccucaauacauguggauugaggugaauacuag

SEQ ID NO: 1192 - RNA, 101 nt, Zea mays
gccggccugagccgccccgcauccccaucccgccgacgugcgcgucccuucgggugggcgcgccgucgucggaugggugcugcgcggugguugaggcccag

SEQ ID NO: 1193 - RNA, 130 nt, Zea mays
uaggcccuguucgguuguuccggauuggagccacggauuaauuccuagccggauuacuucucuaauuuauauagauuuugaugagcuggaaugaauccuggcuuauuccgguacaaccgaacgagcccuu

SEQ ID NO: 1194 - RNA, 94 nt, Zea mays
aaaggcguaauugagugcagcgcuggugagccgccgcagccgacaggggaggcacggcggcuggcucaucaacgcugcgcucaaugaugccuuu

SEQ ID NO: 1195 - RNA, 145 nt, Zea mays
guccacuugaggacauguuuguuuuuaucuuaauccaugugauuggacgggauuguauggguuuaaauuccuaacaagucaaaauucuuccuaauuuuuccaauccacgugggaugggaauaaccgaacaaggccugauuaagug

SEQ ID NO: 1196 - RNA, 108 nt, Zea mays
guggaggacuccaaagggaucgcauugaucuauucucaccugccgccugcugcaugcgaugcgagucgacgacaagaucagugcaaucccuuuggaauuuuccacucg

SEQ ID NO: 1197 - RNA, 68 nt, Zea mays
cuauuuguuuuuaguugucgcuggauagugcaaaauuaaacuauccagcgacaacuaaaaagaaacgg

SEQ ID NO: 1198 - RNA, 106 nt, Zea mays
gguccguucugacuguugagcuuauauugaugaugugacguuuucauuaugcuggcuauagcauaauaguagcucaggggauguaguucagaugguagaacgcucg

SEQ ID NO: 1199 - RNA, 124 nt, Zea mays
aggcccuccgggggcgaccugagaacacaugcaagaucaacgcgcgccgacggcccaggccagcacgaccgagcaaugaucucaucucauucccauguguucccaguccgcccccgccggaacu

SEQ ID NO: 1200 - RNA, 105 nt, Zea mays
cuaguauugaccucaauccacauguguugauguagauuggaguguaaauuaguuuaaguuacaccccaauccacaucaauacauguggauugaggucaauaauag

SEQ ID NO: 1201 - RNA, 112 nt, Zea mays
guuagugugggaauucuauuuuuucaagugauuuuuauuuuuccaaggaaaaaugaacuaauuuccccuugaaaauggaaaucccuugggaaaaugagguucccaaacuagc

SEQ ID NO: 1202 - RNA, 103 nt, Zea mays
cuguggaaauguguggugguacacacuucacaacauaguuacaacauugaagagaaucgugacuacaaugaguggaacugcacuaucacuauaggucuauagc

SEQ ID NO: 1203 - RNA, 105 nt, Zea mays
uccuguauucaccuuaauccauguguauugaggcagauuggaguguaaaauaguuuaauuuacgccucaauccaccucaauauacauggauugagaugaauacga

SEQ ID NO: 1204 - RNA, 77 nt, Zea mays
acccuagcccugcgccaggucgcggaucguccggcucuugaccgcggaccguccgcgccugugcagagaucaucgcc

SEQ ID NO: 1205 - RNA, 100 nt, Zea mays
uuugcgggcguggcaucaucaagauucacaacccaucaauccgaaccacugauuuggaaugcaugcaugagaaucuugaugaugcugcauccgccaacaa

SEQ ID NO: 1206 - RNA, 130 nt, Zea mays; identical to SEQ ID NO: 1171

SEQ ID NO: 1207 - RNA, 69 nt, Zea mays
uccguuucuuuuaaguugucgcuggauaguuuaauuuugcacuauccagcgacaacuaaaacgaagcgg

SEQ ID NO: 1208 - RNA, 130 nt, Zea mays
uagggccuguucgguuguuccggauuggagccccggauuaauuccuagccggauuauuucucuaauuuauauagauuuugaugagcuggaaugaauccuggcucauuccgguacaaccgaacaggcccuu

SEQ ID NO: 1209 - RNA, 179 nt, Zea mays
acucgagcucugguguuuucucauccaaaucuuguuauucggcauuguuuaugggagcuguuucuuuccagccauggaaauggguguggaagucgugggcaccccccaaaugcaaauuuuuuguuuggcuggcgauaaggaauaaauguuggacugcggauagacuucagaggaaagga

SEQ ID NO: 1210 - RNA, 113 nt, Zea mays
ggcgguuccuuaagaaaaccgccacuagaaaucauggauuuuuacaggcgguuuucuuaagaaaccgucuuuagaaauaugauuucuagugucgguuuuauuaaggaaucgcc

SEQ ID NO: 1211 - RNA, 152 nt, Zea mays
gcuaacuuaggcuucuucgguucgcucucaauccauguggauuaagugugauuaggugugauuaaauuccaagcaagucaaacuucuuauuuuuuuccagucauauccaauucauauguaaugggaauaaccgaacaaggccuuauguagau

SEQ ID NO: 1212 - RNA, 197 nt, Zea mays
aucacuuauuuggugcaagugugcaaucaaaccauuuagagcauccaaucuaaaccuaaugguuucauaugaaaggggcuacaaguaaaauagguacuagguuccagauggaaguaguuaaauguaaaauaacaaucaucauuagaucuagauuauaugcaccagaucuuaauuacacgcuugcacuuauaagugau

SEQ ID NO: 1213 - RNA, 68 nt, Zea mays
ccguuucuuuuuaguugucgcuggauaguugaauuuugcacuauccagcgacaacuaaaacgaaacag

SEQ ID NO: 1214 - RNA, 64 nt, Zea mays
augcuccucauccugugguacuuguucuugaccugggggugaguacagcaagggugagcucaca

SEQ ID NO: 1215 - RNA, 157 nt, Zea mays
cgccacuuuaggccuuguucgguuauucccaauacacauggauuggaugggauuggaaaaaauucuuaauaaguuugacuuauuugggauucaaaccaauccaaucccacucaauccacauggauugagagcuaaccgaacaagcccuuaggguuca

SEQ ID NO: 1216 - RNA, 103 nt, Zea mays
gguguuaaaguuuagcacuacauuuuuaaauaaaauauagugcuugaagauucaaacaagaguacuuaaaugugcuaaaagugaagugcuaaacuuuagcaca

SEQ ID NO: 1217 - RNA, 157 nt, Zea mays
caauccguaagggcuuguucgguuagcucucaauccauguggauugagugggauuagauggauuuaaaucccaagcaagucaaacuucuucuuaauuuuuuccaaucucauacaauccuugugcaaugggaauaaccgaacaaggccuaaaugggug

SEQ ID NO: 1218 - RNA, 230 nt, Zea mays
uaaauugaggugguuccaaacauaccgguuuauaacucaguauauagaaauuggauucucaguuuuuuaaaaaccaagaagcuggucacuccuggcuaaaaaauaaaagcaguuucuuagaaacugaguuucuuccaaacaggaccuaguuuuuuuguuuugaagaaacuaagaauccagauucuauaaauuaggguauaagcugguguguuuggaaccaccucaguuuu

SEQ ID NO: 1219 - RNA, 157 nt, Zea mays
uaccacucuaggccuuguucgguuauucccaauacauauggauuggaugggauuggaaaaaauucuuaagaacuuugacuuguuugggauucaaacccauccaaucccacucaauccacauggauugagagcuaaccgaacaaggcccuacaugugu

SEQ ID NO: 1220 - RNA, 160 nt, Zea mays
gagguguuugguuucuagugacuaauauuuagucccuacauuuuauuucauuuaaguuccaaaauuacuaaauguuuuaguuucuauauuuggcaauuuauacacuaaaauggaauaaaaugaugagacuaaacauuagucucuagaaaccaaacaccca

SEQ ID NO: 1221 - RNA, 146 nt, Zea mays
gugcuugcaggugcagcaccaucaagauucacaucguccaacucaugcaucaugcauauaugcaucuucaaugaugcgugccucgcauguguguguauauauauaugaugagaugagaaucuugaugaugcugcaucagcagacac

SEQ ID NO: 1222 - RNA, 102 nt, Zea mays
gauaaaaugauuucuaguggcgguuccuuaagaaaagcgccacuagaaauugauuucuacaugcgguuccuuaagaaaaccgccacuagaaaucaugaauuu

SEQ ID NO: 1223 - RNA, 165 nt, Zea mays
agcgugcaagcaaacaaucugauucuuuagauuacgauccaaccauagauacaaccaugguuuguuaggguuuuuuuauaaagauuauuaagcuggugguggaaggguguaaguguuaaaugugaccuaugguuggaucacaaucuaauggaucagaugguuugc

SEQ ID NO: 1224 - RNA, 227 nt, Zea mays
acgacugcuauguaagcaaucauucugugcaagcgugcaaacaaaccauuugauauauuagaucgugauccaaccguaggucacauuuaacacuuaaaccuuccaccacuaguucaauaaucuuuauaaaaaaacucuaacaaaccaugguuguauaugugguuggaucguaauuuaauggaucagaugguuugcuugcacagaaggacugcuugcauaacagucgu

SEQ ID NO: 1225 - RNA, 200 nt, Zea mays; identical to SEQ ID NO: 1102

SEQ ID NO: 1226 - RNA, 125 nt, Zea mays
cacaagaagaugaagcugccagcaugaucugaaaccauacguguucuuugauucccaucugaagaaagaguuggcuuucauggagaaccgacggucagaucauguggcaguuucauuuucucgug

SEQ ID NO: 1227 - RNA, 181 nt, Zea mays
aaacugguuuuugcugacauggcgaugguuuugccauguaggauggguuuauauuaugcacaaccauucacuagauugagaugaaauugagaaccgaauuuaauggugaaaccauccuacgugguauuuagaucuacugcugacauggugaaaccaucaccaugucagcaaaaaucagcuu

SEQ ID NO: 1228 - RNA, 85 nt, Zea mays
cuggaguuaggguguuuggcaugcucuggccagcuccuccuuggaguuuugcucuggagccaugccaaacaggcccuaauauuag

SEQ ID NO: 1229 - RNA, 107 nt, Zea mays
agaguacuaagauauuggcacggcucaaucagaaacagcagcggcauagcacaugaucucgcgcgcguacgucgucugagugagccgagccaacaucauagcuacua

SEQ ID NO: 1230 - RNA, 164 nt, Zea mays
augaaggaguuggcgacgacguacugcagcggcuggcccccugccgugguugaagagcgccaucccgccccuugggugaaaguugaaggcggcgaaagcgcgggaaguacaugcacauguugagggcugguggcguugugguagccggcgagcgacuccucgua

SEQ ID NO: 1231 - RNA, 181 nt, Zea mays; identical to SEQ ID NO: 1227

SEQ ID NO: 1232 - RNA, 87 nt, Zea mays; identical to SEQ ID NO: 1114

SEQ ID NO: 1233 - RNA, 107 nt, Zea mays
cuccacuugaggggaaugaagccugguccgagaucgacaagaaccuagaccgaugagaucuguauguuucugcaccucgagccagacaacauuccccucaaaguaag

SEQ ID NO: 1234 - RNA, 107 nt, Zea mays; identical to SEQ ID NO: 1229

SEQ ID NO: 1235 - RNA, 106 nt, Zea mays
aguagcuaugauguuggcucggcucacucagacgacguacgcgcgcgagaucaugugcuaugccgcugcuguuucugauugagccgugccaauaucuuaguacucu

SEQ ID NO: 1236 - RNA, 196 nt, Zea mays
gaaccgugauggagaaggagaccacgugcgugcacagccagcaugcaugagcucgcuagcuuauugcuucuccgaucgauccaguccgagcuacguacauccauccauggagauagcuagaugcaguagugguggagaggagagaucgagaauggcguaugugcaugcacgugcccugcuucuccagcgugguccu

SEQ ID NO: 1237 - RNA, 123 nt, Zea mays; identical to SEQ ID NO: 1068

SEQ ID NO: 1238 - RNA, 85 nt, Zea mays
cuggaguuaggguguuuggcaugcucuggucagcuccuccuuggaguuuugcucuggagccaugccaaacaggcccuauaugucc

SEQ ID NO: 1239 - RNA, 71 nt, Zea mays
cggugccgauggucgucgagcuugagcacggcgaggaguccgccggcagccacgaccaccaccaccaccug

SEQ ID NO: 1240 - RNA, 202 nt, Zea mays
gggcaugcuuuccacaggcuuucuugaacugugaacucgugggugguggugguaugucggauggaaugcuuggcuccucccagcuagcaauucucuucccccaugcaccggccgugaauugagcugcggagcuuccccgcagccucgcucucggccggcucuaccuguugaugguucaagaaagcccauggaaaccaugcag

SEQ ID NO: 1241 - RNA, 61 nt, Zea mays
aaugauccucucucaagucucuaagcaauuuaguugauuuuggagcuuggaguggauugaa

SEQ ID NO: 1242 - RNA, 230 nt, Zea mays
augacgguuguguaagcaguccuucuguguaagcaaaccaucugauccauuaaauuacgauccaaccacauauacaaccacgguuuguuaggaguuuuuuuauaaagauuauugagaugguggugggagggguuuaauuauuaaaugugacauacgguuguuauacgaucuaacagaucagaugauuugcuugcacgcuugcacagaaggacugcuugcacaacagucau

SEQ ID NO: 1243 - RNA, 181 nt, Zea mays; identical to SEQ ID NO: 1227

SEQ ID NO: 1244 - RNA, 130 nt, Zea mays
uaggcccuguucgguuguuccggauuggagccccggauuaauuccuagccggauuacuucucuaauuuauauagauuuugaugagcuggaaugaauccuggcucauuccgguacaaccgaacaggcccgu

SEQ ID NO: 1245 - RNA, 130 nt, Zea mays
uaggcccuguucgguuguuccggauuggagccccggauuaauuccuagccggauuacuucucuaauuuauauagauuuuaaugagcuggaaugaauccuggcucauuccgguacaaccgaacggacccuu

SEQ ID NO: 1246 - RNA, 76 nt, Zea mays
uucaaacuauccgcaacuaucgacaagacgcauaaaauuaguauagugaccuuaucaauaugaugcaaguaaacaa

SEQ ID NO: 1247 - RNA, 78 nt, Zea mays
ccucauuuacuugcaccauaucgauaagaucgcuauacugcuuguaugcgucuugucgauaguugcgggcagauugaa

SEQ ID NO: 1248 - RNA, 102 nt, Zea mays
cuaguauucaccagaauccacauguauugagauggauugggguguaaaguuuaauuuacaccccaauuaaccucaauacauguggauugaggugaauacuag

SEQ ID NO: 1249 - RNA, 99 nt, Zea mays
auuagcaggugaaacugcgcagcacgaucuggaucuuagguauccaaaguugccaguaaacgaaagaucagaucaugcuggcagcuucagcugcuuaau

SEQ ID NO: 1250 - RNA, 85 nt, Zea mays
cuggaguuaggguguuuggcaugcucuggccagcuccuccuuggaguuuugcucuggagccaugccaaacaggcccuauguugcc

SEQ ID NO: 1251 - RNA, 202 nt, Zea mays
ggucuuaaggcggugcucccuucaaaccaauaaacggucgaucugaugggugguacagcugcucguucaugguucccacugucccaucucaucagagagagagagagaugcuugagaugggcuugugguuugcaugaccgaggagcugcacguccccuucguugaccgcuguuuggauugaagggagcucugcaucuugguc

SEQ ID NO: 1252 - RNA, 163 nt, Zea mays
caaacuuuuaaucugaaccacaugauguugaucuaaagggugugcggggggagugggaggggggauuugaaaaaaugugauuagcagcgggugguuaaguguaaaauuauccacgccccuguguccauuggaucaacaucauguggcccagauuacaaguuug

SEQ ID NO: 1253 - RNA, 130 nt, Zea mays
aaggcccuguucgguuguuccggauuggagccccggauuaauuccuagccggauuacuucucuaauuuauauauauuuugaugagcuggaaugaauccugucucauuccgauauaaccgaacaggcccua

SEQ ID NO: 1254 - RNA, 132 nt, Zea mays
cggugcucgguggagagggcggacacaugaacgaccacccaaacucaccaagccgccgggagcuccagcagcgagccagcgggaguggaacuggauggucgcucacguguccugcuucuccacccugcacaa

SEQ ID NO: 1255 - RNA, 111 nt, Zea mays
ugugagagcuugaagcugccagcaugaucuggcuacucaaacgccgccgggccuccaagugcucgaucgguggcgcuucaccagaucauguugcagcuucacucucucgca

SEQ ID NO: 1256 - RNA, 146 nt, Zea mays
guugaguuggggggaaugaagccugguccgaaaccuuccaccaucaugcauggauagaugcaggcgggcauaugcugcuuccauggcauggaugauuaauucgcgguguuaggucuccaaccagacaacauuccccucaacugccg

SEQ ID NO: 1257 - RNA, 105 nt, Zea mays
aguccuguuacagggcaacucuccuuuggcagaggguugaagagagcagagagcuauggcaucucaugcuucccugccaagaaagagaagcccugaaacuggaca

SEQ ID NO: 1258 - RNA, 263 nt, Zea mays
uagauuccaaucgaaccauaaagcuugcagcacgggugcaaaguuaaaauuauuugaacgcauuacuuacaauuuguauuauauuauuacuuuuuauaauaaaucguuuauuuuuuuucacgacacaugucaaugucauuaaaaaaauaauaaacgauuuauaauaaaaaaacuaauauuauaauacgaaauguauguaaugaguuuaaauaaguuuaccuuugucaaccgugcuacaaacuuuaugguucgauuugaaaauc

SEQ ID NO: 1259 - RNA, 130 nt, Zea mays; identical to SEQ ID NO: 1084

SEQ ID NO: 1260 - RNA, 134 nt, Zea mays
cuauuccugaggggaaugaagccugguccgagaucuuguagaucugaggaacaaaaaaaacuacacaugcaagcauggaucauccucaaaucggauagcaagaccuugaaccagacaacauuccacucagaagc

SEQ ID NO: 1261 - RNA, 107 nt, Zea mays
gaauaguuccuuggcauucuguccaccuccucucgccgaucuugcagaaaguuuaccaguucuguuggauuuuuuuuggaggugggcauacugccaauggagcugug

SEQ ID NO: 1262 - RNA, 130 nt, Zea mays
cucugcaauuucccacagcuuuauugaacugcccucuugcuugcuuggaucaauugaaacucgaucagguccacagcacagccugcugcaugcaugaugcaguucaagaaagcuguggaagauggcaggg

SEQ ID NO: 1263 - RNA, 105 nt, Zea mays
cucguauucaccucaauccacauggacugauguggauugggguguaaauuaauuuaaguuauacucuaaucgaccucaauacauguggauugaggugaauacaag

SEQ ID NO: 1264 - RNA, 229 nt, Zea mays
ggaacuuuaggggguguuugaaugcacuagagcuauuaguuaguuggcuaaauagaauuagcuagugcauucaaacaauauauuuuugaaacuugcuaguagaauuagcuagcuaacuauuagcuaauuugcuaaaaguagcuagaguguuuggauguauucagcuaauuuuaacauauaauuauuaguucuaucagcuauagugcauucaaacaccccuuuaguuggc

SEQ ID NO: 1265 - RNA, 145 nt, Zea mays
ggcaguugaggggaauguugucugguuggagaccuaacaccgcgaauuaaucauccaugccauggaagcagcauaugcccgccugcaucuauccaugcaugaugguggaagguuucggaccaggcuucauuccccccaacucaac

SEQ ID NO: 1266 - RNA, 104 nt, Zea mays; identical to SEQ ID NO: 1048

SEQ ID NO: 1267 - RNA, 104 nt, Zea mays; identical to SEQ ID NO: 1048

SEQ ID NO: 1268 - RNA, 212 nt, Zea mays; identical to SEQ ID NO: 1170

SEQ ID NO: 1269 - RNA, 196 nt, Zea mays; identical to SEQ ID NO: 1236

SEQ ID NO: 1270 - RNA, 122 nt, Zea mays
cugguuugguuuccugccuaaggcgccacaacuugccuaagcuuagucgcucgaauugaaaaacuaaccuuagacagaaaaguuauucaaguugugacgcuuuaagcaggaaaccaaacuaa

SEQ ID NO: 1271 - RNA, 74 nt, Zea mays
gguugcucgguagggcuuggucgccugcuccgccucgcaagguugcucgacagggacuuggucaccugcucugc

SEQ ID NO: 1272 - RNA, 229 nt, Zea mays
acgacugcuaugcaagcaguccuucugugcaagcaauccaucugauccauuagaucgugauccaaccguaggucauauuuaacacuuaaacccuuccaccagcagcucaauaaucuuuauaaaaaaauccuuaacaaaccaugguuguaucugugauuggaucguaaucuaauguaucagaugauuugcuugcacgcuugcacagaaggacugcuuacauagcagucgu

SEQ ID NO: 1273 - RNA, 179 nt, Zea mays
acucgagcucugguguuuucucuuccaaaucuuguuauucggcguuguuuaugggagcuauuacuuuccagccauggaaauggguguggaagucgugggcaccccccaaaugcaaauuuuuuguuuggcuggcgauaaggaauaaauguuggacugcggauagacuucagaggaaagga

SEQ ID NO: 1274 - RNA, 107 nt, Zea mays; identical to SEQ ID NO: 1229

SEQ ID NO: 1275 - RNA, 107 nt, Zea mays; identical to SEQ ID NO: 1229

SEQ ID NO: 1276 - RNA, 107 nt, Zea mays; identical to SEQ ID NO: 1229

SEQ ID NO: 1277 - RNA, 107 nt, Zea mays; identical to SEQ ID NO: 1229

SEQ ID NO: 1278 - RNA, 107 nt, Zea mays; identical to SEQ ID NO: 1229

SEQ ID NO: 1279 - RNA, 106 nt, Zea mays; identical to SEQ ID NO: 1235

SEQ ID NO: 1280 - RNA, 106 nt, Zea mays; identical to SEQ ID NO: 1235

SEQ ID NO: 1281 - RNA, 107 nt, Zea mays; identical to SEQ ID NO: 1229

SEQ ID NO: 1282 - RNA, 107 nt, Zea mays; identical to SEQ ID NO: 1229

SEQ ID NO: 1283 - RNA, 107 nt, Zea mays; identical to SEQ ID NO: 1229

SEQ ID NO: 1284 - RNA, 107 nt, Zea mays; identical to SEQ ID NO: 1229

SEQ ID NO: 1285 - RNA, 106 nt, Zea mays; identical to SEQ ID NO: 1235

SEQ ID NO: 1286 - RNA, 107 nt, Zea mays; identical to SEQ ID NO: 1229

SEQ ID NO: 1287 - RNA, 107 nt, Zea mays; identical to SEQ ID NO: 1229

SEQ ID NO: 1288 - RNA, 107 nt, Zea mays; identical to SEQ ID NO: 1229

SEQ ID NO: 1289 - RNA, 107 nt, Zea mays; identical to SEQ ID NO: 1229

SEQ ID NO: 1290 - RNA, 83 nt, Zea mays; identical to SEQ ID NO: 1069

SEQ ID NO: 1291 - RNA, 113 nt, Zea mays
ccugugugcguacguggaggguuaaauggauaagugcuugcuacuaccugagucaccagcuucaucuggcuccuggcagcagugugcaucauccuaacguguaggaguaggug

SEQ ID NO: 1292 - RNA, 114 nt, Zea mays
ccaaagaccauagugucggaucguggaccucaauucguauccaaguuuugggaagaacuucauaaaucccugaguaccaaauuacuccacaguucggccuaucauccucaaacc

SEQ ID NO: 1293 - RNA, 111 nt, Zea mays
auggugauacuugcagguggggcgccaggggacuccgcucgucaagguaguugacaccuuggaaugccgcggcgugcggaauggcguguccgcgcugagggaugaacaggu

SEQ ID NO: 1294 - RNA, 100 nt, Zea mays
ugugagauacuaugugcagaaaccuaagagaacuacacaugaaaucauagaguuucaauguggaucucuuagguuuguacacauagcgcgucauauuuuu

SEQ ID NO: 1295 - RNA, 181 nt, Zea mays
aagcugauuuuugcugacauggugaugguuucaccaugucagcaguagaucuaaauaccacguaggaugguuucaccauuaaauucgguucucaauuucaucucaaucuagugaaugguugugcauaauauaaacccauccuacauggcaaaaccaucgccaugucagcaaaaaccaguuu

SEQ ID NO: 1296 - RNA, 181 nt, Zea mays; identical to SEQ ID NO: 1295

SEQ ID NO: 1297 - RNA, 181 nt, Zea mays; identical to SEQ ID NO: 1295

SEQ ID NO: 1298 - RNA, 181 nt, Zea mays; identical to SEQ ID NO: 1295

SEQ ID NO: 1299 - RNA, 181 nt, Zea mays; identical to SEQ ID NO: 1227

SEQ ID NO: 1300 - RNA, 181 nt, Zea mays; identical to SEQ ID NO: 1227

SEQ ID NO: 1301 - RNA, 181 nt, Zea mays; identical to SEQ ID NO: 1295

SEQ ID NO: 1302 - RNA, 183 nt, Zea mays
aaacugguuuuugcugacauggcgaugguuuugccauguaaggauggguuuauauuaugcacaaccauucacuagauugagaugaaauugagaaccgaauuuaauggugaaaccauccuacguggguauuuagauucuacugcugacauggugaaacaucaccaugucagcaaaaaucagcuu

SEQ ID NO: 1303 - RNA, 181 nt, Zea mays; identical to SEQ ID NO: 1227

SEQ ID NO: 1304 - RNA, 182 nt, Zea mays
aagcugauuuuugcugacaugggugaugguuucaccaugucagcaguagaucuaaauaccacguaggaugguuucaccauuaaauucgguucucaauuucaucucaaucuagugaaugguugugcauaauauaaacccauccuacauggcaaaaccaucgccaugucagcaaaaaccaguuu

SEQ ID NO: 1305 - RNA, 181 nt, Zea mays; identical to SEQ ID NO: 1227

SEQ ID NO: 1306 - RNA, 77 nt, Zea mays
agaacguggguaccgucgaacuuaaugggcagcccucgccgacccacguaggacccauaaguucgaccgccaccugu

SEQ ID NO: 1307 - RNA, 114 nt, Zea mays
ccaaagacuauagugucggaucguggacaacaauuuguaucuaaauucugggaagaacuucauaaaucccuggguacuaaguuacuccacaguucggccuaucauccucaaacu

SEQ ID NO: 1308 - RNA, 107 nt, Zea mays
cuccacuugaggggaaugaagccugguccgagaucgacaagaaccuagaccgaugagaucuguauguuucugcaccucgagccagacaacauucuccucaaaguaag

SEQ ID NO: 1309 - RNA, 104 nt, Zea mays
gugagaaucacagugcgguucuccucuggcacgaaggcuggccagagcagcuuauauugccaccacccuuccuugccaaaggagaauugcccugucuuucucaa

SEQ ID NO: 1310 - RNA, 86 nt, Zea mays
ugucggaccauggaccacaauuuguaucuaaauuuuggagugaacugcauaaauccuuggguacuaaacugcuccacaguuucggc

SEQ ID NO: 1311 - RNA, 97 nt, Zea mays
cuacaugguaucaagcagugauuacauaucguccgacuaaucgcgauuagucacgauuagucggccugaucgguuguuagugcucgauaagagguag

SEQ ID NO: 1312 - RNA, 229 nt, Zea mays
acgacuguuaugcaagcaguccuucugugcaagcaaaccaucugauucauuagaucgucauccaaccguaggucacauuuaacacuuaaucucuuccaccaccagcucaauaaucuuuauaaaaaaaccccuaacaaaucaugguuguaucugugguuggaucuuuaucuauuggaucagaugguuugcuugcacucuugcacagaagaacugcuugcauaacagucau

SEQ ID NO: 1313 - RNA, 115 nt, Zea mays
ccgaagacuauagugucggaucguggaccucaauuuguauccaaauucuaggaagaauuucacaaaucccuuggguacuaaauuacuccacaguucggccuaucaucccucaaac

SEQ ID NO: 1314 - RNA, 98 nt, Zea mays
auugaccugcucauggauugucauaaucuagguaucauaaucuagcuuaaauaaucuagauuaugauaccuagauuaugauaauccauaagcagguca

SEQ ID NO: 1315 - RNA, 98 nt, Zea mays; identical to SEQ ID NO: 1314

SEQ ID NO: 1316 - RNA, 76 nt, Zea mays
auuuuaaauagaugugagagguucuuugugaaaaaaaugacguggcacuuggaacaguuuuuauaugugaauaaag

SEQ ID NO: 1317 - RNA, 97 nt, Zea mays
ucugagggacugccggguuauuccgauuuaaguuuguuacgaccccugaggugugacuuaggcacuuaagcuggaauaauucgggcgguucugccac

SEQ ID NO: 1318 - RNA, 102 nt, Zea mays
guugugagacauuauguguagaaaccuaagagaacuacacaugaaaucauagaguuucaauguggaucucuuagguuuguacacauagugcgucacagcuuu

SEQ ID NO: 1319 - RNA, 102 nt, Zea mays
guugugagacauuauguguagaaaccuaagagaaccacacaugaaaucauagaguuucaauguggaucucuuagguuuguacacauagugcguuacaccuuu

SEQ ID NO: 1320 - RNA, 130 nt, Zea mays
agggccuguuugguucguggcuaacugugccacacuuugccuaagguuagucguucgaauugaagaacuaaucuuagacagaaaaguuaggcaaaauggggcaaguuaggcaucaauccaaacaggcccu

SEQ ID NO: 1321 - RNA, 104 nt, Zea mays
aaagcuguaacgcacuauguguacaaaccuaagagauccacauugaaacucuaugauuucaugugugguucucuuagguuucuacacauagugucucacaacuu

SEQ ID NO: 1322 - RNA, 166 nt, Zea mays
uauuaaaucaucaucacuuauuuuaaaucuaacgucucuagucguuugguauauuuugcuaaugacacccuccaacguggugguguguggugguggaagguguuauuuguaaauugaaugauuaaucagagacgauagaucuaaaaugaguggugaugauuuacua

SEQ ID NO: 1323 - RNA, 107 nt, Zea mays
ucuauuauugaccacaauucacguguauugagguggauuuggguguaacuuaaacuaauguacaacucaauccaccucaacacauguggauugaggucaauaauaga

SEQ ID NO: 1324 - RNA, 117 nt, Zea mays; identical to SEQ ID NO: 1041

SEQ ID NO: 1325 - RNA, 104 nt, Zea mays
aaagcuguaacgcacuauguguacaaaccuaagagauccacauugaaacucuaugauuucauguguaguucucuuagguuucuacauauaaugucucacaacuu

SEQ ID NO: 1326 - RNA, 97 nt, Zea mays
uccgaagaacuaauggguuauuccgauuuaaguguguugcugccuuuaaggugcaacucgggcacuuaagcuggaauaauucgggcgguucugccac

SEQ ID NO: 1327 - RNA, 102 nt, Zea mays
aaagcuguaacgcacuauguguacaaaccuaagagauccacauugaaacuaugauuucauguguaguucucuuagguuucuacacauaaugucucacaacuu

SEQ ID NO: 1328 - RNA, 104 nt, Zea mays
aaagcuguaacgcacuauguguacaaaccuaagagauucacauugaaacucuaugauuucaugugugguucucuuagguuucuacacauaaugucucacaacuu

SEQ ID NO: 1329 - RNA, 63 nt, Zea mays
aucaauccaaggggugucugccaagggacacacccauugacauugcaccccuacacauguaua

SEQ ID NO: 1330 - RNA, 391 nt, Zea mays
aaagacguuagaucuaaaaugaguggugaugauuuaauauguggaccaugugcaccaauauucuauguacaccagauauauguucucaaaaaauaaagcucgacagugcuaguacauucuggacacauggaauucguggaaaauagucgggauacaagccgucgaagccguggcacccaaggugcaugauagagccaaagccuaccaagaucucuguuagauucaugaaccccaacaaugaaguccaaugcuugcuagucugucuacaucuauacauaauacuccaucucuguuugaauacacuaacaguuagucgcuaaaauuaauagaaaacauccaaauaguccagcuaauagaucaucuaugagcugcuuuuagcuagugucgggga

SEQ ID NO: 1331 - RNA, 102 nt, Zea mays
guugugagacauuauguguagaaaccuaaaagaaccacacaugaaaucauagaguuucaauguggaucccuuagguuuguacacauagugcguuacagcuuu

SEQ ID NO: 1332 - RNA, 102 nt, Zea mays
guuaugagacauuauguguagaaaccuaagagaacuacacaugaaaucauagaguuucaauguggaucucuuagguuuguacacauagugcguuacagcuuu

SEQ ID NO: 1333 - RNA, 97 nt, Zea mays
ucugagggacugacggguuauuccgauuuaaguguguuacggcccuugaggcgugacuuaggcacuuaagcuggaauaauucgggcgguucugccac

SEQ ID NO: 1334 - RNA, 247 nt, Zea mays
augaaauuuguccacgugucaugauaucauauauauauauauaugcugugauaaaauuuugagaaaguuucgaaaaaguugagacauacuauguguagaaaccuaagagaacuacacaugaaaucauaaaguuucaauguaguucuccuagguuucuacacauaguaugucacaacuuucucgaaacauucucaaauuuuuaucacagccucuacauaugauaucaucuccagaggacaaguuucau

SEQ ID NO: 1335 - RNA, 102 nt, Zea mays; identical to SEQ ID NO: 1319

SEQ ID NO: 1336 - RNA, 107 nt, Zea mays
auagugaagauggcggggagcguccgagaggaggccagauguggagcaccacuuacauguggagaaggcccgagacucuuuacggaguuaccugucacacugcuugg

SEQ ID NO: 1337 - RNA, 104 nt, Zea mays; identical to SEQ ID NO: 1048

SEQ ID NO: 1338 - RNA, 97 nt, Zea mays
ucugagggacugacggguuauuccgauuuaaguguguuacggccccugaggcgugacuuaggcacuuaagcuggaauaauucgggcgguuccgccac

SEQ ID NO: 1339 - RNA, 98 nt, Zea mays
  misc_feature (62)..(62): n is a, c, g, or u
uccgagggacugucggguuauuccgguuuaaguguguugcugcccuugcgggcgugacuugngcacuuaagcuggaauaauucgggcgguuccgccac

SEQ ID NO: 1340 - RNA, 97 nt, Zea mays
  misc_feature (61)..(61): n is a, c, g, or u
ucugagggacugacggguuguuccgauuuaaguguguuguggccucuaaggcgugacuugngcacuuaagcuggaauaauucgggcgguuccaccac

SEQ ID NO: 1341 - RNA, 97 nt, Zea mays
ucugagggacuaacgaguuauuccgauuuaaguguguuauggcccgugaggcgugacuuaggcacuuaagcuggaauaauucgggcgguucugccac

SEQ ID NO: 1342 - RNA, 148 nt, Zea mays
uaacaacguggguaccgacguucuuaauugaguuaaguucauggguuuguugaaaaacguggauacccauguucuuaguuuaaaucugugcgcccuagcuaaaaccgucgaacuuaucguauuagaaacguggauacccacguucuua

SEQ ID NO: 1343 - RNA, 144 nt, Zea mays
gcaaaccaggcuguuugcagccccucacaaaaaugaggauaggccccaccugcaguuccaccagauaacaguugaguuguguuauugaucugcaggugaggucuauccucauauuugugaggggcugcaaauagacugguuuug

SEQ ID NO: 1344 - RNA, 97 nt, Zea mays
ucugagggacuaacggguuauuccgauuuaaguguguuacggccccuggggcgugacuuaggcacuuaagcuggaauaauucgggcgguucugccac

SEQ ID NO: 1345 - RNA, 241 nt, Zea mays
augaaacuuguccacgugucaugauaucauauguacagguugugauaaaaaauugaaaaaauuucgagaaaacuaugacgcgcuauguguacaaaccuaagagauccacauugaaacucuaugauuucauguguaguucucuuaaguuucuacacauagugucucacaacuuuguccaaacauucucaauuuuuuaucacaaccuguacauaugauaucaugacacguggacaaguuucau

SEQ ID NO: 1346 - RNA, 98 nt, Zea mays
uccgagggacugacugguuauuccuguuuaaguguguugcugcccuuaagggugcgacuugggcacuuaagcuggaauaauucgggcgguuccaccac

SEQ ID NO: 1347 - RNA, 241 nt, Zea mays
augaaacuucuccacgugucaugauaucauauguacaggcagugauaaaaauuugaaaaaguuucgagaaaacugugacgcacuauguguagaaaccuaagagauccacauugaaacucuauaauuccauguguaguuuucuuagguuucuacacauagugucucacaacuuucuccaaacauucuaaaauuuuuaucacaaccucuauauaugauaucaugacauguugaaauguuucau

SEQ ID NO: 1348 - RNA, 97 nt, Zea mays
ucugagggacugacggguuauucugauuuaaguguauugcggccucuaaggcgugacuugggcacuuaagcuggaauaauucgggcgguucugcuag

SEQ ID NO: 1349 - RNA, 164 nt, Zea mays
uauuaaaucaucaccacucauuuuagaucuaacgucucuaguuguuugguauauuuuacugagaacacccuccaauguggugguguguagugguggaagauguuauuuguaaauugaaugaucaauuagagacguuagaucuaaaaugagugguaauuauuuaa

SEQ ID NO: 1350 - RNA, 79 nt, Zea mays
gcacauuuaguucagcaaagaagucuggagcuggaagaucugcuucacacaucaaagacucaugcugaaggugcauacu

SEQ ID NO: 1351 - RNA, 104 nt, Zea mays
aaagcuguaacgcacuauguguacaaaccuaagagauccacauugaaacucuaugauuucaugugugguucucuuagguuucuacacauaaugucucacaacuu

SEQ ID NO: 1352 - RNA, 97 nt, Zea mays
ucugagggacugacggguuauuccgauuuaaguguguugcggccucuaaggcgugacuugggcacuuaagcuggaauaauucgggcgguucugccac

SEQ ID NO: 1353 - RNA, 144 nt, Zea mays
gcaaaccaggcuguuugcagccccucacaaaaauauggauagaccccaccuguagguccaccagauaacguuuuaguuguguuauugaccugcgggagggaccuauccucauuuuugcgaggggcugccaacagcucuguguuu

SEQ ID NO: 1354 - RNA, 107 nt, Zea mays
ucuaguauugaccucaauccacauguguugaggugaauugugguguaaauuaguuuaaguuacaccucaauccaucucaauacauauggauuagggucaauacuaga

SEQ ID NO: 1355 - RNA, 166 nt, Zea mays
uauuaaaucauuaccacucauuuuguaucuaauguuucuaguuguuugguauauuuugcuaaggacacccuccaauguagugguguauagugguggaagauguuauuuguaaauugaaugaucaacuauagacguuagaucuaaaaugaguggugaugauuuaaua

SEQ ID NO: 1356 - RNA, 70 nt, Zea mays
agcugggacuucgagggcgaugaugaaggacuuggccaucguggcgucguccccuccggaagaugcgaca

SEQ ID NO: 1357 - RNA, 104 nt, Zea mays
aaaacugugacgcacuauguguacaaaccuaagagauccacauugaaacucuaugauuucaugcguaguucucuuagguuuguacacauaaugucucacaacuu

SEQ ID NO: 1358 - RNA, 105 nt, Zea mays
uccacuuuauuucauuuuaguucauaaauuguuaaauagggaaacuaaaauagaguuuuaguuucuauauuuaguaauuuagggacuaaaauggaauaaaauuga

SEQ ID NO: 1359 - RNA, 105 nt, Zea mays
aaagcugugacgcacuauguuuagaaaccuaagagauccacacaugaaaucauagaguuucaauguggaucucuuagguuuguacacauagugcgucacagcuuu

SEQ ID NO: 1360 - RNA, 120 nt, Zea mays
uaagggcugauuuggugacaaugggaucacgggggauugaagggauuauggggaaaugaacuaauuuccuccucaaucuccucuaauccccgugaucccuggucaccaaaucagcucuaa

SEQ ID NO: 1361 - RNA, 102 nt, Zea mays
guugugagacauuauguguagaaaccuaagagaacuacacauaaaaucuuagaguuuuaauguggaucucuuagguuuguacacauagugcgucacagcuuu

SEQ ID NO: 1362 - RNA, 104 nt, Zea mays
aaagcuguaacgcacuauguguacaaaccuaagagauccacauugaaacgcuaugauuucaugugugguucucuuagguuucuacacauaaugucucacaacuu

SEQ ID NO: 1363 - RNA, 102 nt, Zea mays
guugugagacauuauguguagaaaccuaagagaaccacacaugaaaucauagaguuucaauguggaucucuuagguuuguacacauagugcguuacagcuuu

SEQ ID NO: 1364 - RNA, 89 nt, Zea mays
uccauuuuauuucauuuuagucccuaaauuaucaaauacauaaacuuucuguauuuaauaauuuagggacuaaaauggaauaaaaugua

SEQ ID NO: 1365 - RNA, 103 nt, Zea mays; identical to SEQ ID NO: 1066

SEQ ID NO: 1366 - RNA, 197 nt, Zea mays; identical to SEQ ID NO: 1067

SEQ ID NO: 1367 - RNA, 162 nt, Zea mays
uguucgguucgcucucaauccauguggauuaagugagauugagucgguuuaaauccauaacaagucuaaauccaucucgauuccguccaauauacuucaauccacauggaucucgauuccguccaauauacuucaauccacauggaucgagaauaaccaaac

SEQ ID NO: 1368 - RNA, 104 nt, Zea mays
aaagcuguaacgcacuauguguacaaaccuaacagauccgcauugacacucuaugacuucaugugugguucucuuagguuuuuacacauaaugucucacaacuu

SEQ ID NO: 1369 - RNA, 108 nt, Zea mays; identical to SEQ ID NO: 1074

SEQ ID NO: 1370 - RNA, 102 nt, Zea mays; identical to SEQ ID NO: 1363

SEQ ID NO: 1371 - RNA, 245 nt, Zea mays
guguccacuguauggacgagucuggugugguauggcaauuaguguuuugaucuucauaaacagggaaguguguguguguuuuggaaauaaaaauaauaccacgggagcgggaagcucaguggugauugagugugaaaaugugcuacuucucucuuuuggguaaaaccucaaguaucaccuuucucugaaaaagaaaugagugacuucaacuccaccguaccaagcauguacuauauaggccccuc

SEQ ID NO: 1372 - RNA, 102 nt, Zea mays; identical to SEQ ID NO: 1077
  misc_feature (99)..(99): n is a, c, g, or u

SEQ ID NO: 1373 - RNA, 102 nt, Zea mays
guugugagacacuauguguagaaaccuaagagaaccacacaugaaaucauagaguuucaauguggaucucuuagguuuguacacauagugcguuacagcuuu

SEQ ID NO: 1374 - RNA, 102 nt, Zea mays; identical to SEQ ID NO: 1319

SEQ ID NO: 1375 - RNA, 104 nt, Zea mays
aaaguuguaacgcacuauguguacaaaccuaagagauccacauugaaacucuaugauuucaugugugguucucuuagguuucuacacauaaugucucguaacuu

SEQ ID NO: 1376 - RNA, 228 nt, Zea mays
aauaucuuaugcaaucacuuauauuggugcaagcgugcaaucaaacgauuuggugcaucuaaucuagaucuaaugaugacuguuauuuuacauuuaaccccuuccaccugaaacauaguaccuauuuuacuuuuaaccccuuucauaugaaaccguuggaucuagauuggaugcucuggaugguuugguugcacgcuugcaccaaaugagugauugcacaggauaugu

SEQ ID NO: 1377 - RNA, 104 nt, Zea mays
aaagguguaacgcacuauguguacaaaccuaagagauccacauugaaacucuaugauuucaugugugguucucuuagguuucuacacauaaugucucacaacuu

SEQ ID NO: 1378 - RNA, 102 nt, Zea mays
guugugagacaguauguguagaaaccuaagagaacuacacaugaaaucauagaguuucaauguggaucucuuagguuuguacacauagugcgucacagcuuu

SEQ ID NO: 1379 - RNA, 102 nt, Zea mays
guugugagacauuauguguagaaaccuaaaagaaccacacaugaaaucauagaguuucaauguggaucucuuagguuuguacacauagugcguuacagcuuu

SEQ ID NO: 1380 - RNA, 130 nt, Zea mays
agagcauguuugguucguggcuaacugugccacacuuugccuaagguuagucguucgaauugaagaacuaaccuuaggcagaaaaguuaggcaaaguguggcaaguuagguagcgaaccaaacaggcccu

SEQ ID NO: 1381 - RNA, 130 nt, Zea mays; identical to SEQ ID NO: 1380

SEQ ID NO: 1382 - RNA, 130 nt, Zea mays; identical to SEQ ID NO: 1380

SEQ ID NO: 1383 - RNA, 130 nt, Zea mays; identical to SEQ ID NO: 1380

SEQ ID NO: 1384 - RNA, 130 nt, Zea mays; identical to SEQ ID NO: 1380

SEQ ID NO: 1385 - RNA, 130 nt, Zea mays
auagcauguuugguucguggcuaacugugccacacuuugccuaagguuagucguucgaauugaagaacuaaccuuaggcagaaaaguuaggcaaaguguggcaaguuagguagcgaaccaaacaggcccu

SEQ ID NO: 1386 - RNA, 78 nt, Zea mays
gccgagucgagccagcucguuagcuuaacgagccuguuucgagcucgaacgagccgagccgagcuggcucgauauuca

SEQ ID NO: 1387 - RNA, 107 nt, Zea mays
ucuaauauugaccucaauccacauguguugagguggauugagguguaacuuaaacuaauuuacaucccaauccaccucaacacauauggauuaaggucaauacuaga

SEQ ID NO: 1388 - RNA, 107 nt, Zea mays; identical to SEQ ID NO: 1387

SEQ ID NO: 1389 - RNA, 94 nt, Zea mays; identical to SEQ ID NO: 1106

SEQ ID NO: 1390 - RNA, 103 nt, Zea mays
uccauuuuauuccauuuuagucccuaaauuacuaaauauagaaacuaaaacucuauuuuaguuucccuauuuaacaauuuauaaacuaaaaugaaauaaagug

SEQ ID NO: 1391 - RNA, 93 nt, Zea mays
auaccacucaauccacuuggauuaauggugaaaugaacaagcucuaaggacuuguucgguuagcucucaauccauguggauuaagugggugga

SEQ ID NO: 1392 - RNA, 146 nt, Zea mays
cauaucgauauuguuuagccacauuuugaaggagaauggaaggucucauaacaaaagaguugcuccuuugauuauaaaacacgagacuugagaaauaaauauucccuccguuucuuuuuuauuagucgcuggauagugcaaaauug

SEQ ID NO: 1393 - RNA, 105 nt, Zea mays
uccacuuuauuccauuuuaguucauaaauuauuaaauagggaaacuuaaauagaguuuuaguuucuauauuuaguaauuuagggacuaaaauggaauaaaauaga

SEQ ID NO: 1394 - RNA, 130 nt, Zea mays
gaggcagacuugcccacucaaauuuucgcaaguuuuggccucauguggugacuaaaaguguuccgauuauccuaaauacacaagacaagaggcuaaaauuugugagaauuugagugggcaagcccguuuc

SEQ ID NO: 1395 - RNA, 105 nt, Zea mays
uccauuuuauuccauuuuagucccuaaauuacuaaauauagaaacuaaaacucuauuuuaguuuccuuauuuaauaauuuaugaacugaaauggaauaaagugga

SEQ ID NO: 1396 - RNA, 73 nt, Zea mays
ucggguuggagcuggcucguuaagcuacugagcuggcucaacucguuaagcuaacgagcuggcucgacuuguu

SEQ ID NO: 1397 - RNA, 197 nt, Zea mays; identical to SEQ ID NO: 1115

SEQ ID NO: 1398 - RNA, 221 nt, Zea mays
uauacaaacaguccuucugugcaagcgugcaaguaaaucaucugauucauuauaucgugauccaaccguauaucacauuuaacacuuaaacccuuccaccacaaacuuaauaaucuuuauaaaaaaaccccuaacaaacuauguuuguaucugugguuggaucguaaucuaauggaucagaugauuugcuuacacgcuugcacagaaagauugcuuguaua

SEQ ID NO: 1399 - RNA, 167 nt, Zea mays
uauuaaaucaucacuauccauaucagaucuaacguuucuguuuaauuauuguaauucauaaauaacaucuuccaccacuacaucucaccauguuagaguguguccuuggcaaaauguaucaaacaacuagagacguuagaucuaaaaugaguggugaugauuuaaua

SEQ ID NO: 1400 - RNA, 124 nt, Zea mays
ucaggguugauuuggugacaaggggaucacgggggguuggaggggauugagggggaauugaacuaauuucccccugaaucccuuucaauccuuccgugaucccuggucaccaaaucagccuuca

SEQ ID NO: 1401 - RNA, 140 nt, Zea mays
gcagcagcgguggaaggggcaugcagaggaggagcacgagcgagguguggcuggaagaagcagccggggccugugugcuauauaccccucgcaagcucuccucacuccucuccugugccugccucuuccauuccuucugc

SEQ ID NO: 1402 - RNA, 143 nt, Zea mays
uuguuugguuacucuaauauugaccucaaauccucaauccauauguguguugagguagauuaggauguaaauuaauuuaagugaaaucucaauuuagcucaauacauguggauugaggucaauacuagaguacccaaacaaag

SEQ ID NO: 1403 - RNA, 124 nt, Zea mays
aauccaagcgcaagagcucaaaugaacacaacaaaucucucucucuaauuacuaaagcuuuguguggaguugggagaggauuugaucucuuuggugugucuuguauugaaugcuauagcucuug

SEQ ID NO: 1404 - RNA, 104 nt, Zea mays
aauuaauuaguacucccuccguuucuuuuuauuugucacuagauaguguaauuuugcacuauccagcgacaaauaaaaagaaauggagggaguaguuaacuaac

SEQ ID NO: 1405 - RNA, 101 nt, Zea mays
uagacgaaucuauugagucuaauuaauccaugauuagaacauguuuacuguagcgaaacaugggcugaucauagauuaacuuggcuuaauagauuuguguc

SEQ ID NO: 1406 - RNA, 262 nt, Zea mays
aggaaaacaggucuucgaacuugaccggccauucaaaacuggauuugcucaaaccggaugccgauguggcaaugccacguugaagucacuugaguucuggaacuugauauguuguaucacuugagucaccgaacuuggcauuaugugucaccugggucuccgaaguuucauuaguacgcuucagcguagcacgccacgucgacaucugguuugagcaaacccgauuuuagauggccgaccaaauucgaggacccauuuuacu

SEQ ID NO: 1407 - RNA, 174 nt, Zea mays
cacauauuaaaucaucaccgcucauuuuagaucuaacgucuuuaguuguuugguauauuuugcuaagcacauccucuaauguggugguguguauugguggaaggugcuauuuguaaauugaaugaucaacaagaaacguuauaucuaaaaugaguggugaugauuuaauaugug

SEQ ID NO: 1408 - RNA, 101 nt, Zea mays
uuaauuuaauuucauuuuaauugcugaguugccaaauacgaaaacuaaaauagaguuuuuuuauauuuguuaauuuagggacuaaaauggagugauuauaa

SEQ ID NO: 1409 - RNA, 127 nt, Zea mays
ggggcuugauuggauuguugccuaaauugucauacuuugucuaacuuuucuauauaagguuaguucaauucaaacgauuaaucuuagguaaaguguggcacaguuagccacgaaccaaacagaccuu

SEQ ID NO: 1410 - RNA, 68 nt, Zea mays
uaccaaguacaucggugcagaguggcgcguauagguauacggaguuauacguauugaugagggcaggu

SEQ ID NO: 1411 - RNA, 130 nt, Zea mays
cgggcauguuugguucgcugccuaacuugucacacuuugccuaacuuuucugucuaagguuaguuuuucaauucggacgauuaaacuuaggcaaaguguggcacaguuagccacgaaccaaacaugucau

SEQ ID NO: 1412 - RNA, 104 nt, Zea mays
uaaaaaaugauacucccuccguuucuuuuuaguugucgcuggauaguucaauuuugcacuaucuagcgacaacuaaaaugaaacggagggaguaacaaaauaga

SEQ ID NO: 1413 - RNA, 156 nt, Zea mays; identical to SEQ ID NO: 1129

SEQ ID NO: 1414 - RNA, 129 nt, Zea mays
uguucguuuagcucucaauccauguggauuaagugugauugagugaauuuaaaucccaaccaaaucaaauuucuucuuaauuuuuuuuuucaaucccgucuaauccauauguaauuggauuaaccgaac

SEQ ID NO: 1415 - RNA, 124 nt, Zea mays
uaaggccugauuuggugacaagggaaucacggaaggauugaagggauugagaggggaaauguacuaauuucucacucaauccccuccaaucccccgugaucccuggucaccaaaucagccguaa

SEQ ID NO: 1416 - RNA, 223 nt, Zea mays
gacauauccuugcaaucacucauuuggugcaagcgugcaaucaaaccauccagagcauccaaucuagauccaacgguuucauauguaagggguuaaaaguaaacuagguucuauguuucagguggaaaggguuaaauuuaaaauaacagucaucauuggaucuagauuagaugcaccaaaucgcuugauugcacguuuguaccaauauaagugacugcauaag

SEQ ID NO: 1417 - RNA, 132 nt, Zea mays
agagcauguuugguucgcugcuuaacuugccacacuuugccugacuuuucugucuaagguuaguucuucaauucggacgacuaaccuuaggagcaaacuguggcacaguuagccacgaaccaaacaagcccu

SEQ ID NO: 1418 - RNA, 110 nt, Zea mays
uagcuuccaauccauguggauugagugggauuggaugaguuuaaaucccaagcaagucaaucuucuucuuaauuuuuuccaaucccauccaauccauggguaacgggauu

SEQ ID NO: 1419 - RNA, 103 nt, Zea mays
acaugagaacuacucccuccguuucuuuuuauuugucgcuggauaguguaaaauuacacuaucuagcgacaaauaaaaaaaacggagggaguacuacauauau

SEQ ID NO: 1420 - RNA, 168 nt, Zea mays
acucucaacauguacauuuggguucuuauacuuguaugguuuugugucaucugggucuuuaaauuuguuuuuuggugucaucaaagguccaaacuccaaaaacaaguuuacgaaaagaggugacacaccuauagaaguauagggacccgaaaugugcauguuaagagu

SEQ ID NO: 1421 - RNA, 227 nt, Zea mays
cauauccugugcaaucacuuauuuggugcaagcgugcaaccaaaccauccagagcauccaaucuagauccaacgguuucauaugaaagggguuaaaaguaaaauagguacuauguuucagguggaagggguuaaauguaaaauaacagucaucauuagaucuagauuaaaugcaucaaaucguuugauuguacgcuugcacuaauauaagugauugcauaagauauu

SEQ ID NO: 1422 - RNA, 130 nt, Zea mays
agggccuguuugguucguggcuaacugugccacacuuugccuaacguuagucguucgaauuaaagaacuaaccuuaggcagaaaaguuaggcaaaguguggcaaguuaggcagcgaaccaaacaggcccu

SEQ ID NO: 1423 - RNA, 232 nt, Zea mays
accuccguucuuaaauauacgaugacguugauuuuuuuuaaaaaaaacuuuagccacucguuuuauucagaaaaaauaugaauuaucauuuauuuuguuuugguuuguuuuaucacuuaaaguuauuugagcauuacuuaaauuuuuacauuuuuaaauaaauauuuugaauaagacgaguggucaaaguuauucaaaaauucaacggugucauauauuuaagaauagaggg

SEQ ID NO: 1424 - RNA, 105 nt, Zea mays
gacacuccgguagcagggaugauuugcccguagaucgaacaguacaggcauuggcauggcaacgacaggaaccacaggcaaaucaucccuggcuaccaaagaugg

SEQ ID NO: 1425 - RNA, 87 nt, Zea mays
uaagggcugauuuggugaccagggaucacgggaggaucaaucccuuccaauccucccgugaccuccuugucaccaaauuaacccuaa

SEQ ID NO: 1426 - RNA, 121 nt, Zea mays
uaagugcugauuuggugguaaggggaucacggagggauugaagaggauugagagggaaaugaacuaauuucccauauccccuccaaucccccgugaucccuggucaccaaaucagcccuaa

SEQ ID NO: 1427 - RNA, 126 nt, Zea mays
uguucguuuugcucucaauccauguggauuaggugggauuggaugaguuucaauccuaaauaagucaaaaucuuucauaauuuuuuccaaucccauccaauccacgugggauaggaauaaccgaac

SEQ ID NO: 1428 - RNA, 87 nt, Zea mays
uccauuuuauuccauagucucuaaauugccaaauauagaaacuaaaauauauuuaauaauuuagggacuaaaauggaauaaaaugga

SEQ ID NO: 1429 - RNA, 68 nt, Zea mays
acuucuucagugcaucaucuguugauggcucuuucagugauuaaacaggugauggcauaguaacaggu

SEQ ID NO: 1430 - RNA, 142 nt, Zea mays
caauuacccacacauguugguguuuaauucauagccagucaauuacauuacauauacauguuggaauauaagugaauuauccaccucuuccuuauagccugaacugguuugugcaugcaacuuaauaugguaucggaacuag

SEQ ID NO: 1431 - RNA, 98 nt, Zea mays
uccgagggacugacggguuauuccuguuuaagugcguugcugcccuuaagggugcgacuugggcacuuaagcuggaauaauucgggcgguuccgccac

SEQ ID NO: 1432 - RNA, 158 nt, Zea mays
aggggguguuuguuugagauuauaaucuguccagauuauauaguccaacuuauuuugaacuagcacuuaguucacagcuuauuuugaacuagcacuuaguucaaaauauauuggauuauauaaucugggcagauuauuaucccaaauaaacacccccc

SEQ ID NO: 1433 - RNA, 142 nt, Zea mays
ucuaguauugacuucaauccacauauguugagguggauugggauauaauccgucucaacacauguggauuaagaucaauauuagaguacccaaaauuacacccuauccaucucaacacauguggauugaggucaauauuagu

SEQ ID NO: 1434 - RNA, 105 nt, Zea mays
uccauuuuauuccauuuuagucccuaaauuacuaaauauggaaacuaaaacuuuauuuuaguuucuuuauuuaacaauuuagaaacuaaaauagaauaaagugga

SEQ ID NO: 1435 - RNA, 85 nt, Zea mays
aguugccguugagcgagcugugcgugccgagguccgcggacacggccgucgugaucagcgcguaggggccguucaccagcauccc

SEQ ID NO: 1436 - RNA, 105 nt, Zea mays
uucacuuuauucuauuuuaguucauaaauuguuaaauagggaaacuaaaauagaguuuuaguuucuauauuuaguaauuuagggacuaaaauggaauaaaaugaa

SEQ ID NO: 1437 - RNA, 97 nt, Zea mays
ucugagggauugacggguuauuucgauuuaaguguguugcugccuccaaggcaugacucggacacuuaagcuggaauaauucgggcgguucuaccau

SEQ ID NO: 1438 - RNA, 72 nt, Zea mays
cuccauuucuuuuuauuagucgcuggauauuguaauuuugcacuauccagcgacuaauaaaaagaaacggag

SEQ ID NO: 1439 - RNA, 271 nt, Zea mays
augguaccauauugaguugcaugcaccaacaaauacaacccaaaauguuaagcugauaggaaaggcgaacaauuucacaauuaaauaaaauaauggugcuugcuccauucuacgucuaagaccagaggaagccuccaugugagggggggggguguuggaguauaagugauuuuguuggaauauaauauaaguggguuguccuccuucuauuagcuuaagcuuuugaauugaacugguuggugcaugcaacuuaauaugguaucagagccag

SEQ ID NO: 1440 - RNA, 229 nt, Zea mays
acauauccugugcaaucacucauuuggugcaagcgugcaaccaaaccauacagagcauccaaucuagauccaacgguuucauaugaaagggguuaaaaguaaaauagguacuauguuucagguggaagggguuaaauguaaaauaacagucaucauuagaucuagauuagaugcacuaaaucguuugauugcacgcuugcaccaauauaagugauugcauaagauauuu

SEQ ID NO: 1441 - RNA, 72 nt, Zea mays
cuuuguuugaguacucuaguauugaccucaauacauguggauuaagcucaauacuagaguacccaaacuagg

SEQ ID NO: 1442 - RNA, 222 nt, Zea mays
uauguaaacaguccuucugugcaagcgugcaaacaaaucaucugauccauuauauuaugauccaaccacaaauacaaucaugguuuguuagagauuuuuuuauaaagauuauugagcugaugguggaaggguuuaaguguuaaaugugacauacgguugaaucacgaucuaauggaucagaugauuugcuuacacguuugcacagaaaagacuguuugcaua

SEQ ID NO: 1443 - RNA, 105 nt, Zea mays
uccacuuuauuccauuuuaauucauaaauuguuaaauagggaaacuaaaauagaguuuuaguuucuauauuuaguaauuuagggacuaaaauggaauaaaaugga

SEQ ID NO: 1444 - RNA, 107 nt, Zea mays
ucuaguauugaccucaauccacauguguugagguggauuggaguguaaauuaguuuaaguuacaccccaauucaccucaauacaaguugauugaggucaauauuaaa

SEQ ID NO: 1445 - RNA, 107 nt, Zea mays
ucuaguauugaccucaauccacauguguugagguggauuagaguguaaauuaguuuaaguuacaccccaauccacuucaauacauguggauuggggucaauacuaga

SEQ ID NO: 1446 - RNA, 107 nt, Zea mays; identical to SEQ ID NO: 1445

SEQ ID NO: 1447 - RNA, 228 nt, Zea mays
aauauccuaugcaaucacuuauccuggugcaagcaugcaaucgagcgaucuggugcauccgaucuagaucuaaugaugacuguuauuuuauauuuaacuccuuccaccuaaaacauaguacuuauuuuacuuuuaaccccuuucauaugaaaccguuggaucuagauuagaugcucugaauaguuugauugcacgcuugcaccaaaaugagugauugcacaggauaug

SEQ ID NO: 1448 - RNA, 97 nt, Zea mays
ucugagggacugacggguuauuccgauuuaaauguguugcggcccuuaaggcgugacugaggcacuuaagcuggaauaauucgggcgguucugccac

SEQ ID NO: 1449 - RNA, 243 nt, Zea mays
cugcaugguuuccaugggcuuucuugaaccaucaacaggucgcgugagcgagccggggggaagcucagcgaugcgauucgauucaauucaauucacggccggucggggggaagagaauuggugggugggacugggacugggacugggaggagccaaucauuccgucccacacacccagcaccagcaccaccaccaccacgcccacgaguucacaguucaagaaagccuguggaaagcaugccc

SEQ ID NO: 1450 - RNA, 236 nt, Zea mays
cguauccgguguaaucauuuauuugaugcaagcgugcaauaaaaccauccauaguauccaaucuuagaaccaacuauguuugcccuuuuuaaauuucuacccuaccacaucauccuccauuuauggagggugaugugggagguuagaaacacaaaacgauauugucauaucuagauuggauguucuaaaugguuugauugcacucuugcaccaaauaagugauugcacaugauaug

SEQ ID NO: 1451 - RNA, 186 nt, Zea mays
guuaugccauuucuucccacggcuuucuugaccuucuucggagaucagagagcgagaggcagagaaugaagaaaguguucguguacacuuuugagagagagagagagagagguucaaagaagcuauacggcccuucuaagagagagaagaagaagaaguucaagaaagcuguggaaaggcauggca

SEQ ID NO: 1452 - RNA, 66 nt, Zea mays
gggguggggaugaguacguugcuggagauagguugucuccagcaacguccucuauauccauccucu

SEQ ID NO: 1453 - RNA, 98 nt, Zea mays
uuagggcugguuuggugaccagggaucacgaggggauccaugggugaauagcaaggggauuccuccccauagaucccuggucaccaaaucagcaugga

SEQ ID NO: 1454 - RNA, 163 nt, Zea mays
gccagcacagugagcgucgugagguugccuagcugcguggggacaaaaaaucaagaauguagggcgagcauggauugguaccccuaagacgcgccgccgcccgcauucuucggucaccgccgcccgcgcagcagcacagccacagcgccaccacggcagcauc

SEQ ID NO: 1455 - RNA, 86 nt, Zea mays
uccauuuuauucuguuuuagucccuaaauuaccaaauaguaguuucuaaauuugguaauuuagggacuaaaauggaauaaaguaga

SEQ ID NO: 1456 - RNA, 130 nt, Zea mays
aaggccuguuugguucguggcuaacugugccacacuuuaccuaagguuagucguccaaauugaaaaacuaacuuuaguuacaaaaguuagacaaaguguggcaaguuagacaacaaaccaaacaaugccc

SEQ ID NO: 1457 - RNA, 185 nt, Zea mays
aaaauuuagccccuaucacaucgaauguuuaaaccucaguucggguuauuaaauguagucgaauuauaaaacuaauuucucagccgaagauuaaaaagugagacgaaucuaguacaguugguagggucuauauuucauacuccuauuugaaagucaaacgcuugaugugacccgggcuaaacuuu

SEQ ID NO: 1458 - RNA, 98 nt, Zea mays
uccgagggacugacggguuauuucgguuuaaguguguugcugcccuugcgugugugacuugggcacuuaagcuggaauaauucgggcgguuccaccac

SEQ ID NO: 1459 - RNA, 104 nt, Zea mays
uagcucucaauccauguggauugagugggauuggaugaguuuaaaucccaaacaagucaaacuucuuaauuuuuuucaaucucauucaauccaugcguauugga

SEQ ID NO: 1460 - RNA, 110 nt, Zea mays
uagccuucaauccauguggauugagugggauuggauggguuugaaucccacgcaagucaaacuucuucauaauuuuuuccaaacccauucaauccauguguauugggaau

SEQ ID NO: 1461 - RNA, 105 nt, Zea mays
uccacuuuauuccauuuuaguuccuaaauuguuaaauagggaaacuaaaauagagcuuuaacuuccauauuuaguaauuuagggacuaaaauggaaugaaaugga

SEQ ID NO: 1462 - RNA, 65 nt, Zea mays
aucaaaaaaugcgccguugccggggaucgaacccgggucacccgcgugacaggcgggaauacuca

SEQ ID NO: 1463 - RNA, 105 nt, Zea mays
uccacuuaauuccauuuuaguucauaaauuguuaaauagggaaacuaaaauagaguuuuaguuucuauauuuaguaauuuagggacuaaaauggaauuaagugga

SEQ ID NO: 1464 - RNA, 66 nt, Zea mays
cuccauuucuuuuuauuagucgcuggauagugcaaaauucccagcgacuaauaaaaagaaacggag

SEQ ID NO: 1465 - RNA, 229 nt, Zea mays
aauaucuuaugcaaucauuuauauuggugcaaacgugcaaucaaacgauuuggugcaucuaaucuagaucuaaugaugacuguuauuuuacauuuaaccccuuccaccugaaacauaguaccuauuuuacuuuuaaccccuuucauaugaaaucguuggaucuagauugaaugcucugggaugguuugguugcacgcuugcaccaaaugagugauugcacaggauaugu

SEQ ID NO: 1466 - RNA, 110 nt, Zea mays; identical to SEQ ID NO: 1182

SEQ ID NO: 1467 - RNA, 105 nt, Zea mays
uucacuuuauuucauuuuaguuuauaaauuguuaaauagggaaacuaaaauagaguuuuaguuucuauauuuaguaauuuagggacuaaaauggaauaaaaugga

SEQ ID NO: 1468 - RNA, 198 nt, Zea mays
acaaaccaggcuauuugcagucccucacaaaaaagaggauagaccucaccugcaagucuaacagauaacguuuuaguuguguuauuggccuacagguggggccuauccucauuuuuguauaacguuuuaguuguguuauuggccuacagguggggccuauccucauuuuugugaggggcugcaaacagccugguuugc

SEQ ID NO: 1469 - RNA, 220 nt, Zea mays
uaugcaaccaguccuucugugcaagcgugcaaguaaaucaucugaucuauuagaucgugauucaaccauaggucauauuuaacacuuaaacccuuccaccaacagcucaauaaucuuuauaaaaaaccccuaauaaaccaugguuguaacugugguugaaucguaaucuaaugaaucagaugauuugcuuguacgcuugcacagaaggacugcuugcaua

SEQ ID NO: 1470 - RNA, 105 nt, Zea mays
ucuacuuuauucuauuuuaauucauaaauuguuaaauaagaaaauuaaaauggaguuuuaguuucuauauuuaguaauuuagggacuaaaauggaauaaaauuga

SEQ ID NO: 1471 - RNA, 123 nt, Zea mays
aauccaagcgcaagagcucaaaugaacacaaguaucucucucucacuagucacuauuugauuggaauugucuuuggacuugggagaggauuugaucucuuugguugugucuuguauugaaugc

SEQ ID NO: 1472 - RNA, 63 nt, Zea mays
aguuuauugauuccucuauggugguacgagcuccgauaccagcuguggcggaacugcccgaau

SEQ ID NO: 1473 - RNA, 107 nt, Zea mays
ccuaguauugaccauaauccacuugcauugagguggauuagggcgcaauuuaaacuaauuuacacuauaauucaccucaacacauguggauugaggucaauacuaga

SEQ ID NO: 1474 - RNA, 156 nt, Zea mays
uaagggcugguuuguugaccaggaucacgaggggauacauaggagaggaauccccuuacuauuuugaaaugaguuaacccucaauacccaaaugagcguuaaggauuucucccucauagauccccucgugaucccuggucaccaaaucagccauaa

SEQ ID NO: 1475 - RNA, 143 nt, Zea mays
uaaaccagccuguuugcagccccucauaaaaaagagaauaugucucaccugcagacuaauaacacaacuaaaacguuauuugaugaaucuguagguagggucuauccuccuuuuugugaggggcugcaaacagagugguuugc

SEQ ID NO: 1476 - RNA, 106 nt, Zea mays
ucaauuuuauuccauuuuagucccuaaauuacuaaauauagaaacuaaaacucuauuuuaguuucucuauuuuaacaauuuaugaacuaaaauagaauaaaauaga

SEQ ID NO: 1477 - RNA, 98 nt, Zea mays
uccgagggacugacagguuauuccuguuuaaguguguugcugcccuuaagggugcgacuugggcacuuaagcuggaauaauucgggcgguuccgccac

SEQ ID NO: 1478 - RNA, 62 nt, Zea mays
uagugugguaucgauuacgguuggacuuaaacaaacaugauucaacguuaucgguuacccau

SEQ ID NO: 1479 - RNA, 101 nt, Zea mays; identical to SEQ ID NO: 1192

SEQ ID NO: 1480 - RNA, 85 nt, Zea mays
uagggguugauuuggugacaaggggaucauucuccucaauccccuccaauccuuccgugaucccuggucaccaaaucagcucuaa

SEQ ID NO: 1481 - RNA, 104 nt, Zea mays
ucuuucuucguacucccuccguuucuuuuuauuugucgccuaguaguucaaauuuauacuaacggacgacauauauuaaggaacggagggaguacuaaauacau

SEQ ID NO: 1482 - RNA, 94 nt, Zea mays; identical to SEQ ID NO: 1194

SEQ ID NO: 1483 - RNA, 130 nt, Zea mays
aaggccuguuugguucguggcuaacugugccacacuuugccuaagguuaguaguccgaauuuaagaacuaaccuuagacagaaaaauuaggcaaaguguggcaaguuaggcagagaaccaaacauacccu

SEQ ID NO: 1484 - RNA, 108 nt, Zea mays; identical to SEQ ID NO: 1196

SEQ ID NO: 1485 - RNA, 105 nt, Zea mays
uccauuuuauuccauuuuagucccuaaauuacuaaauauagaaacuaaaacucuauuuuaguuuccauauuuaacaauuuaugaauuaaaauggaauaaaguaga

SEQ ID NO: 1486 - RNA, 107 nt, Zea mays
ucuaguauuaaccucaauccacauguguugaggcggauugggguguaaauuaguuuaaguuacaccccaauccaccuuaauacauguggauuggggucaauacuaaa

SEQ ID NO: 1487 - RNA, 230 nt, Zea mays
aucuauucuaggugcuaaaugauuucagaaauucauaacucaauauccguagcuccgaauuuagugguucuuauuucuacgaucuuguagcaacacguagaucauaauuauacaguucauccuuaugucugguguaauguuaauuuugccuauacacuguuuguuuguaaugcuacgacuagcgugaggacacgugucaucugaagagcaaguugguaccuggaaucuca

SEQ ID NO: 1488 - RNA, 105 nt, Zea mays
ucaauuuuauuccauuuuagucccuaaauuacuaaauauagaaacuaaaacucuauuuuaauuucccuauuuaacaauuuaugaacuaaaauggaauaaagugga

SEQ ID NO: 1489 - RNA, 112 nt, Zea mays
aaugguccguucugacuguugagcuuauauugaugaugugacguuuucauuaugcuggcuauagcauaauaguagcucaggggauguaguucagaugguagaacgcucgcuu

SEQ ID NO: 1490 - RNA, 84 nt, Zea mays
cuccguuucuuuuuauuagucgcuggauagugucagcgacuaauaaaaagaaacggagccagcgacuaauaaaaagaaacggag

SEQ ID NO: 1491 - RNA, 166 nt, Zea mays; identical to SEQ ID NO: 1355

SEQ ID NO: 1492 - RNA, 72 nt, Zea mays
cuccguuucuuuuuauuagucacuggauaguguaauuuuacacuauccagcgacuaauaaaaagaaacggag

SEQ ID NO: 1493 - RNA, 130 nt, Zea mays
aggguauguuugguucgcugucuaacuuaucacacuuugccuaacuuuucugccuaagguuaguucuucaacucgaacgacuaaccuuaggcaaaguguggcacaguuagccacgaaccaaacaagccuu

SEQ ID NO: 1494 - RNA, 104 nt, Zea mays
ucaaaacuuauacucccuccguuucuuuuuauuugucgcuggauaguauaaaauuacacuauccaacgacaaauaaaaagaaacggagagaguauaaauuagag

SEQ ID NO: 1495 - RNA, 234 nt, Zea mays
cauaucaugugcaaucacuuauuuggugcaagagugcaaucaaaccauuuagaacauccaaucuagauaugacaaugucguuuuguguuucuaaccucccacaucacccuccauaaauggaggaugaugugguaggguagaaauuuaaaaagggcaaacauaguugguucuaagauuggauacuauggaugguuuuauugcacgcuugcaucaaauaaaugauuacaccggaua

SEQ ID NO: 1496 - RNA, 105 nt, Zea mays
ucuauuuuauuccauuuuagucccuaaauuacuaaauaaggaaguuaaaacucuauuuuaguuucccuauuuaacaauuuagaaacuaaaauggaauaaagugga

SEQ ID NO: 1497 - RNA, 119 nt, Zea mays
aauccaagcgcaagagcucaaaugaacacaagucacucucucacuuagucacuauuuguggaaugaucuuuggacuugggagaggauuugaucucuuuggugugucuuguauugaaugc

SEQ ID NO: 1498 - RNA, 72 nt, Zea mays
cuccguuucuuuuuauuagucgcuggauagugcaaaauuacacuacccagcuacuaauaaaaagaaacggag

SEQ ID NO: 1499 - RNA, 72 nt, Zea mays
cuccguuucuuuuuauuaguagcuggguaguguaauuuugcacuauccagcgacuaauaaaaagaaacggag

SEQ ID NO: 1500 - RNA, 124 nt, Zea mays; identical to SEQ ID NO: 1199

SEQ ID NO: 1501 - RNA, 107 nt, Zea mays
ucuaguauugaccucaauccacauguguugauguagauuggaguguaaauuaguuuaaguuacaccccaauccacaucaauacauguggauugaggucaauaauaga

SEQ ID NO: 1502 - RNA, 130 nt, Zea mays
agggcauguuugguucguggcuaacugugccacgauuugccuaagguuagucguucaaauuuaagaacuaaccuuagacauaaaaguuaggcaaaguguggcaaguuaggcagcaaaccaaacaggcccu

SEQ ID NO: 1503 - RNA, 112 nt, Zea mays; identical to SEQ ID NO: 1201

SEQ ID NO: 1504 - RNA, 129 nt, Zea mays
ucucgauuuugcucuguggaaauguguggugguacacacuucacaacauaguuacaacauugaagagaaucgugacuacaaugaguggaacugcacuaucacuauaggucuauagcaguagaguuauga

SEQ ID NO: 1505 - RNA, 100 nt, Zea mays; identical to SEQ ID NO: 1205

SEQ ID NO: 1506 - RNA, 218 nt, Zea mays
uaugcaagcaguccuucugugcaagcgugcaaacaaaccauuugauccauuagaucgugaucuaaucguaagucacguuuaacauuuaaacccuuccaccaccagcucaguaaucuuuauaaaaaacccuaacaaaccauaguuguaucugugguuggauuguaaucuaauggauagaugguuuauuugcacguuugcccagaaugacuguuugaaua

SEQ ID NO: 1507 - RNA, 218 nt, Zea mays
ccagaaauuagccaguugaguaaagauggcaccaaaaacuguccugaucaaaacaaugccuguguacgugcaacgacuguguuuucccccauaaauaacuaagccuuuuaucaguugaguaaagauggcagccaccuuacgcaaucuuguuaagaauacaauuuguucaaauucaauuauuucauuauggccuauuagcucaguugguuagagcgucg

SEQ ID NO: 1508 - RNA, 166 nt, Zea mays
uauuaaauaauuaccacucauuuuagaucuaacgucucuaauugaucauucaauuuacaaauaacaucuuccaccacuacacaccaccacauuggaggguguucucaguaaaauauaccaaacaacuagagacguuagaucuaaaaugaguggugaugauuuaaua

SEQ ID NO: 1509 - RNA, 166 nt, Zea mays
uauuaaaucaucaccacucauuuuagaucuaaugucucuaguugauuauucaauuuacaaauaacaccuuucaccacuacacaccaccacguuggaggguguccuuaguaaaauguaccaaacaaauagagacguuagauuuaaaaugaguggugaugauuuaaua

SEQ ID NO: 1510 - RNA, 72 nt, Zea mays
cuccguuucuuuuuauuagucgcuggauagugcaauuuuguacuaucuagcgacuaauaaaaagaaacggag

SEQ ID NO: 1511 - RNA, 341 nt, Zea mays
uagugugguaucgauuacgguuggacuuaaauaaacaugaucuagcguuauugguuacccauuacguuaccaauaugugaaccaaacgacaccuugacucuauuucguaugaugaaaucuuguacagugugguuuuuuauuuucuguuucuuauauguggucauccagcgcuuuugcagguggagaagccaauuugucccuccaacauaguauuucugaccuuaaacggggaucaugaugcauuuaacaaaagaguagaguauaauauuuguaacuuaauugguaagugauaacguaaaauuauguuuguuuaauuucaacuguaaucagauaucacacua

SEQ ID NO: 1512 - RNA, 143 nt, Zea mays; identical to SEQ ID NO: 1475

SEQ ID NO: 1513 - RNA, 185 nt, Zea mays
aaaauuuagcuccuaucacaucgaauguuugaaccuccguucgggguauuaaauguagucggauuauaaaacuaauuucucagccgaagauuaaaaagugagacgaaucuaguacaauugguugggucuauauuucauacuccuauuugaaagucaaacgcuugaugugacccgggcuaaacuuu

SEQ ID NO: 1514 - RNA, 107 nt, Zea mays
gagacacaaaaccagagggaauugaaggggauaaaauccaccucuuauucaaaauugaauaaggaggggauuuuagccccuccaauucccuccggguuuuggacucc

SEQ ID NO: 1515 - RNA, 185 nt, Zea mays
aaaauuuagucucuaucacaucgaauguuugaaccuccguuugggguauuaaauguaaucggauuauaaaacuaauuucucagcuaaagauuaaaaagugagacgaaucuaguacaguugguugggucuauauuucauacuccuauuugaaagucaaacgcuugaugugacccgggcuaaacuuu

SEQ ID NO: 1516 - RNA, 105 nt, Zea mays
uucauuuuauuccauuuuagucccuaaauuauuaaauauauaaacuaaaacucuauuuuaguuucccuauuuaacaauuuaugaacuaaaauggaauaaagugaa

SEQ ID NO: 1517 - RNA, 130 nt, Zea mays
gggauauuuuugguucgcugccuaacuugccacacuuugccuaacuuuucugccuaagguuaguucuuaaauucggacgacuaacuuuaggcaaaguguggcacaguuagccacgaaccaaacaggccuu

SEQ ID NO: 1518 - RNA, 105 nt, Zea mays
uuuuagucccuccauuuuagucccuaaauuacaaaauacagaaacuaaaacucuauuuuaguuucuguauuuagcaauuuauagacuaaaauggaauaaaauaga

SEQ ID NO: 1519 - RNA, 137 nt, Zea mays
guuaugucauuucuucccacagcuuucuugaccuucgucuucggagaugagagagagagagacagauucgaagaaagcugccguuccaagagagaagaagaagaagaaguucaagaaagcuguggaaaggcauggca

SEQ ID NO: 1520 - RNA, 221 nt, Zea mays
uaugcaagcaguccuucugugcaagcguacaagcaaaccaucuaauccauuagauuacgauccaaccacagauacaaucaugauuuguuaggaguuuuuuuauaaagauuauugagcugguggugaaaggguuuacgcguuaaaugugaccuacgauuggaucacgaucuaauggaucagaugguuugcuugcacgcuugcacagaaggacuguuugcaua

SEQ ID NO: 1521 - RNA, 133 nt, Zea mays
uaguuuggauacucuaguauuaaccccaauacacauguauugagguggauuuaggcguaacuuaaacuaauuuacaccauaaucugccucaaugcaugugaauugaggucaauacuagaguacccgaacaaag

SEQ ID NO: 1522 - RNA, 146 nt, Zea mays; identical to SEQ ID NO: 1221

SEQ ID NO: 1523 - RNA, 105 nt, Zea mays
ucuacuuuauuccauuuuaguucauaaauuguuaaauagggaaacuaaaauagaguuuuaguuucuauauuuaguaauuuagggacuaaaauggaauaaaauggg

SEQ ID NO: 1524 - RNA, 104 nt, Zea mays
agcagauucauacucccuccguuucuuuuuaguugucgcuggauaguuuaauuuuacacuauccaccgacaacuaaaacgaaauggagggaguggcuuggguag

SEQ ID NO: 1525 - RNA, 105 nt, Zea mays
uccacuuuuuuccauuuuaguuuauaaauuguuaaauagggaaacuaaaauaaaguuuuaguuucuauauuuaguaauuuagggacuaaaauggaauaaaauuga

SEQ ID NO: 1526 - RNA, 104 nt, Zea mays
ucgauuguauuacucccuccguuucuuuuuauuuaucguuggauaguguaauuuuacacuauccagcgacaaauaaaaagaaacggagagaguauuauuuauua

SEQ ID NO: 1527 - RNA, 120 nt, Zea mays; identical to SEQ ID NO: 1360

SEQ ID NO: 1528 - RNA, 105 nt, Zea mays
ucaauuuuauuccauuuuagucccuaaauuacuaaauauagaaacuaaaacucuauuuuaguuucucuauuuaacaacuuaugaacuaaaauggaauaaagugca

SEQ ID NO: 1529 - RNA, 228 nt, Zea mays
aaacacccccuuaaauauaugacaccguugacuuuuuuugaaaacuuugaccacuugucuuauucaaaauauuuauucaaaaauauaaaguuucaagucauacucaaacaaccuuaaaugauaaaacaaaccauaacaaaauaaauauuaauucacauuuuuuuaauaagacgauuagucaaaguuuuaaaaaagucaacgacgucauauauuuauaagaacggaggu

SEQ ID NO: 1530 - RNA, 126 nt, Zea mays
uguucgguuagcucucaauccauguggauuaagcgggauuggauggauuugaaucccaaacagcucaaacuucuucacaauuuuuuccaaucucauccaauccauguguauugggaauaaccgaac

SEQ ID NO: 1531 - RNA, 104 nt, Zea mays
ccacuuaauuccauuuuagucccuaaauuacuaaauauagaaacuaaaacucuauuuuaguuucccuauuuagcaauuuaugaacuaaaauggaauuaagugga

SEQ ID NO: 1532 - RNA, 125 nt, Zea mays; identical to SEQ ID NO: 1226

SEQ ID NO: 1533 - RNA, 229 nt, Zea mays
aaauccguucuuaaauauauaacgucauugacuuuuuuaaaaaaacuuugaccacucaucuuauucaacaaaaaaugugaaauaucauuuauuuuguuauaauuuguuuuaucacuuaagauuguuugagcgugacuuaaaauuuuacauuuuuugauaaauguuuugaauaaacaaauggucaaaguuuuuuuaaagucaacggugucauauauuuaagaacggaggg

SEQ ID NO: 1534 - RNA, 107 nt, Zea mays; identical to SEQ ID NO: 1229

SEQ ID NO: 1535 - RNA, 107 nt, Zea mays; identical to SEQ ID NO: 1233

SEQ ID NO: 1536 - RNA, 107 nt, Zea mays; identical to SEQ ID NO: 1229

SEQ ID NO: 1537 - RNA, 106 nt, Zea mays; identical to SEQ ID NO: 1235

SEQ ID NO: 1538 - RNA, 196 nt, Zea mays; identical to SEQ ID NO: 1236

SEQ ID NO: 1539 - RNA, 64 nt, Zea mays
uagugugguaucgauuacgguuggacuuaaacaaacaugauuuaacguuaucgguuacucauua

SEQ ID NO: 1540 - RNA, 202 nt, Zea mays; identical to SEQ ID NO: 1240

SEQ ID NO: 1541 - RNA, 148 nt, Zea mays
uaagaauguggguaccgacguucuuaauugaguuauguucgucgguuaauuuaagaauguggguacccacguucuuauauuaaauucaugggcccgugagaaaaccgucgaacuuauaguauuaggaacguggguacccacguucuua

SEQ ID NO: 1542 - RNA, 79 nt, Zea mays
uccauuuuauuccauuuuagucccuaaauuacuaaauaccuuauuuaacaauuuaugaacugaaauagaauaaagugaa

SEQ ID NO: 1543 - RNA, 189 nt, Zea mays
cauggugcacauauuaaaucaucagcacucauuuuaaaucuaacgucuaauaguuguuugguauauuuugcuaaugacacccuccaacggggugggguguggugguggaagguguuauuuguaaauugaaugaucaaucagagacguuagaucuaaaaugaguggugauaauuuaauaugugcaccaug

SEQ ID NO: 1544 - RNA, 105 nt, Zea mays; identical to SEQ ID NO: 1434

SEQ ID NO: 1545 - RNA, 130 nt, Zea mays; identical to SEQ ID NO: 1456

SEQ ID NO: 1546 - RNA, 98 nt, Zea mays
aacaagucgagccagcucguuagcuuaacgaguugagccagcucaguagcuuaacgagccagcuccaacccgaaugagucgaguuggcuagauaucca

SEQ ID NO: 1547 - RNA, 135 nt, Zea mays
guaaacuagacuguuuguagccucucucacagaaaggagguagaccucaucugcaggucacguuuugauuguauuguugcaccugcaggugggaucuauucuccuuuuugugaggggcugcaaacagucugguuu

SEQ ID NO: 1548 - RNA, 158 nt, Zea mays
aggggguguuuguuugagauuauaaucuguccagauuauauaguccaacuuauuuugaacuagcacuuaauucacagcuuauuuugaacuagcacuuacuucaaaauauauuggauuauauaaucugggcagauuauuaucccaaauaaacacccccc

SEQ ID NO: 1549 - RNA, 85 nt, Zea mays
agacgacauggcgugguauuguuucggcucauguccuucuugacuggaugugaugugagccgaaccaauaucacucauguauucu

SEQ ID NO: 1550 - RNA, 130 nt, Zea mays
agggucuguuugguucguggcuaacugugccacacuuugccuaagguuagucguccgaauugaagaacuaaccuuaggcagaaaaguuaggcaaaguguggcaaguuaggcagcaaaccaaacaugcccu

SEQ ID NO: 1551 - RNA, 220 nt, Zea mays
auacaaauuugccuuaugugcaagcgugcaagcaaaccaucugauccauuagaucgugauccaacuguaggucacauuuaacacuuaaacucuuccaccaccagcucaauauuuuuuauaaaaaaaucccuaacaaaccaugguuguaucugugguuggaucguaauauaauggaucagaugguuuguuugcacgcuugcacagaaggacggcuugcgua

SEQ ID NO: 1552 - RNA, 87 nt, Zea mays; identical to SEQ ID NO: 1425

SEQ ID NO: 1553 - RNA, 159 nt, Zea mays
gugcacauuuuaaaucuggugcauccaucuuacauucaacggcaccggcuaauuuuacgaagaaccccuuccaccaggggacgaagguggaaagggugcuucacaaaauuggugcugcuguuauauguaagauggauacaccagauuuaaaaugugcac

SEQ ID NO: 1554 - RNA, 99 nt, Zea mays; identical to SEQ ID NO: 1249

SEQ ID NO: 1555 - RNA, 228 nt, Zea mays
aauauccuaugcaaucacuuauccuggugcaagcaugcauucaagcgaucuggugcauccaaucuauaucuaaugaugacuguuauuuuauauuuaacccauuccacauaaaacauaguaccuauuuuacuuuuaaccccuuucauaugaaaccguuggaucuggauugaaugcuuuggauaguuuaauuguacuuuugcaccaaaaugagugauugcucaggauaug

SEQ ID NO: 1556 - RNA, 105 nt, Zea mays
uucauuuuauuccauuuuagucccuaaauuacuaaauauagaaacuaaaacucuauuuuaguuucccuauuuaacaauuuaugaaguaaaauagaauaaagugaa

SEQ ID NO: 1557 - RNA, 202 nt, Zea mays; identical to SEQ ID NO: 1251

SEQ ID NO: 1558 - RNA, 132 nt, Zea mays; identical to SEQ ID NO: 1254

SEQ ID NO: 1559 - RNA, 121 nt, Zea mays
cugccucugguagccaaggaugacuugccuacauggucucgcuaguuccgguuguugcaugcaugccacuaugccaguccugcuggguuugugggcggucuccuuggcuagccugaguggc

SEQ ID NO: 1560 - RNA, 111 nt, Zea mays; identical to SEQ ID NO: 1255

SEQ ID NO: 1561 - RNA, 130 nt, Zea mays; identical to SEQ ID NO: 1502

SEQ ID NO: 1562 - RNA, 146 nt, Zea mays; identical to SEQ ID NO: 1256

SEQ ID NO: 1563 - RNA, 89 nt, Zea mays
gucgagccgagccagcucguuagcuuaacgagucagcucgaacucagucaaaucgagccagcucauuagcuuaacgagucaacucgaac

SEQ ID NO: 1564 - RNA, 128 nt, Zea mays
agggccuguuugguucguggcuaacugugccacacuuugccuaaaguuagucguucaaauugaagaacuaaccuuaugcagaaaacuuaggcaaaguguggcaaguuagacucuaaaccaaacaggcc

SEQ ID NO: 1565 - RNA, 105 nt, Zea mays; identical to SEQ ID NO: 1257

SEQ ID NO: 1566 - RNA, 131 nt, Zea mays
ugggccuguuugguucguggcuaacugugccacacuuuaccuaaguuuagucguccgaauugaagaacuaaccuuaggcagaaaaaguuaggcaaauuauggcaaguuaggcaggaaaccaaacaugccca

SEQ ID NO: 1567 - RNA, 79 nt, Zea mays; identical to SEQ ID NO: 1542

SEQ ID NO: 1568 - RNA, 134 nt, Zea mays; identical to SEQ ID NO: 1260

SEQ ID NO: 1569 - RNA, 130 nt, Zea mays; identical to SEQ ID NO: 1456

SEQ ID NO: 1570 - RNA, 86 nt, Zea mays
aggggcuggguuuggugaccaaauaucacgaggggaucauucaccauggauccacucgugaucccuggucaccaaaucagcccuua

SEQ ID NO: 1571 - RNA, 107 nt, Zea mays; identical to SEQ ID NO: 1261

SEQ ID NO: 1572 - RNA, 130 nt, Zea mays; identical to SEQ ID NO: 1262

SEQ ID NO: 1573 - RNA, 105 nt, Zea mays
ucaauuuuauuccauuuuagucccuaaauuacuaaauauagaaacuaaaacucuauuuuaguuucccuauuuaacaauuuaugaacuaaaauagaauaaaauaga

SEQ ID NO: 1574 - RNA, 105 nt, Zea mays
uccacuuuauuccauuuuaguuucuaaauuguuaaauagggaaacuaaaauagaguuuuaacuuccuuauuuaguaauuuagggacuaaaauggaauaaaauaga

SEQ ID NO: 1575 - RNA, 145 nt, Zea mays; identical to SEQ ID NO: 1265

SEQ ID NO: 1576 - RNA, 104 nt, Zea mays; identical to SEQ ID NO: 1048

SEQ ID NO: 1577 - RNA, 104 nt, Zea mays; identical to SEQ ID NO: 1048

SEQ ID NO: 1578 - RNA, 196 nt, Zea mays; identical to SEQ ID NO: 1236

SEQ ID NO: 1579 - RNA, 106 nt, Zea mays
acuugggagauggcggggagcguccgagaggagccgggagcgggagcacacuuacgcguggagaagcccacagcucuauacggaguuacucgaccguggugcuugg

SEQ ID NO: 1580 - RNA, 105 nt, Zea mays
ucuaauauugacuaauccacauguauugagguguauugggguguaacuuaaacuaauuuacacauuaauccaccucaacacauguggauugaggucaauacuaga

SEQ ID NO: 1581 - RNA, 222 nt, Zea mays
uaugcaagcagucauucuggugcaagcgugcaagcaaaccaucugauccauuagaaucaugauccaaaucguaugucacauuuaacacuuaaacccuucuaccacuagcucaauaaucuuuauaaaaaaaccuaacaaaccaugguuguaucugugguuggaucguaaucuaauagaucagauaguuugcuugcacgcuugcacagaaggacuguuuguaua

SEQ ID NO: 1582 - RNA, 66 nt, Zea mays
gauuugucucgucuagacuuucggccgggggugcuuuuugaggcugauguuuggcgccgguuuucc

SEQ ID NO: 1583 - RNA, 107 nt, Zea mays; identical to SEQ ID NO: 1229

SEQ ID NO: 1584 - RNA, 106 nt, Zea mays
agaguacuaagauauuggcacggcucaaucagaaacagcagcggcauagcacaugaucucgcgcgcguacgucgucugagugagccgagccaacaucauagcuacu

SEQ ID NO: 1585 - RNA, 107 nt, Zea mays; identical to SEQ ID NO: 1229

SEQ ID NO: 1586 - RNA, 107 nt, Zea mays; identical to SEQ ID NO: 1229

SEQ ID NO: 1587 - RNA, 107 nt, Zea mays; identical to SEQ ID NO: 1229

SEQ ID NO: 1588 - RNA, 107 nt, Zea mays; identical to SEQ ID NO: 1229

SEQ ID NO: 1589 - RNA, 106 nt, Zea mays; identical to SEQ ID NO: 1235

SEQ ID NO: 1590 - RNA, 106 nt, Zea mays; identical to SEQ ID NO: 1235

SEQ ID NO: 1591 - RNA, 107 nt, Zea mays; identical to SEQ ID NO: 1229

SEQ ID NO: 1592 - RNA, 107 nt, Zea mays; identical to SEQ ID NO: 1229

SEQ ID NO: 1593 - RNA, 107 nt, Zea mays; identical to SEQ ID NO: 1229

SEQ ID NO: 1594 - RNA, 107 nt, Zea mays; identical to SEQ ID NO: 1229

SEQ ID NO: 1595 - RNA, 106 nt, Zea mays; identical to SEQ ID NO: 1235

SEQ ID NO: 1596 - RNA, 107 nt, Zea mays; identical to SEQ ID NO: 1229

SEQ ID NO: 1597 - RNA, 107 nt, Zea mays; identical to SEQ ID NO: 1229

SEQ ID NO: 1598 - RNA, 107 nt, Zea mays; identical to SEQ ID NO: 1229

SEQ ID NO: 1599 - RNA, 107 nt, Zea mays; identical to SEQ ID NO: 1229

SEQ ID NO: 1600 - RNA, 86 nt, Zea mays
aacaaauaugcuaaagcugauaugcacaaccugcaagccuaucaaaaacuucaaaauagcaauugggcguguucggcuggcuacaa

SEQ ID NO: 1601 - RNA, 76 nt, Zea mays
uacaagucgagccagcucguuagcuuaacgagccaucucgagcucggacgagcugaccgagcuaguucgauauuca

SEQ ID NO: 1602 - RNA, 126 nt, Zea mays; identical to SEQ ID NO: 1530

SEQ ID NO: 1603 - RNA, 126 nt, Zea mays; identical to SEQ ID NO: 1530

SEQ ID NO: 1604 - RNA, 126 nt, Zea mays; identical to SEQ ID NO: 1530

SEQ ID NO: 1605 - RNA, 125 nt, Zea mays
guucgguuagcucucaauccauguggauuaagcgggauuggauggauuugaaucccaaacagcucaaacuucuucacaauuuuuuccaaucucauccaauccauguguauugggaauaaccgaac

SEQ ID NO: 1606 - RNA, 126 nt, Zea mays; identical to SEQ ID NO: 1530

SEQ ID NO: 1607 - RNA, 126 nt, Zea mays; identical to SEQ ID NO: 1530

SEQ ID NO: 1608 - RNA, 126 nt, Zea mays; identical to SEQ ID NO: 1530

SEQ ID NO: 1609 - RNA, 126 nt, Zea mays; identical to SEQ ID NO: 1530

SEQ ID NO: 1610 - RNA, 126 nt, Zea mays; identical to SEQ ID NO: 1530

SEQ ID NO: 1611 - RNA, 98 nt, Zea mays
guauugacccuaauccacauguauugagguggauuuguguguaacuuaaacuaauuuacacucaaauccaccucaacacaucuggauaggugcuaaua

SEQ ID NO: 1612 - RNA, 107 nt, Zea mays; identical to SEQ ID NO: 1308

SEQ ID NO: 1613 - RNA, 104 nt, Zea mays; identical to SEQ ID NO: 1309

SEQ ID NO: 1614 - RNA, 229 nt, Zea mays
acauauccugugcaaucacucauuuggugcaagcgugcaaccaaaccauccagagcauccaaucuagauccaacgguuucauaugaaaguggguuaaaaguaaaauagguacuauguuucagguggaagggguuaaauguaaaauaacagucaucauuaaaucuagauuagaugcaccaaaucguuugauugcacgcuugcaccaauauaagugauugcauaagauauu

SEQ ID NO: 1615 - RNA, 67 nt, Zea mays
acacgaacucuagguuaaagauauacauggaaagucaucacaaauaucuaugggcuagaagcaaauu

SEQ ID NO: 1616 - RNA, 105 nt, Zea mays
ccaucuuugguagccagggaugauuugccuguuguuucugucguugccaugccaaugccuguacuguucgaucuacgggcaaaucaucccugcuaccggaguguc

SEQ ID NO: 1617 - RNA, 135 nt, Zea mays
uuuuguuuggguacucuaguauuuaccucaauucccauguguugauguugauugggguguaaauuaguuuaaguuacacucuaauccaccucaauacauguggauugaggucaauacuagaguacccaaacuagc

SEQ ID NO: 1618 - RNA, 87 nt, Zea mays
uaagggcugauuugguaacaaggggaucacaucccccucaauccccuccaauccucccgugaucccuggucaccaaaucaacucuga

SEQ ID NO: 1619 - RNA, 66 nt, Oryza sativa
ugggccuaugcucguuacgaugggccggcccggcaugggccgguccaaugaucaguuaggcaaaaa

SEQ ID NO: 1620 - RNA, 222 nt, Oryza sativa
caucaguacauuacagaguauuagaagagugcugugguuguaacccagaugugucuuuuuuuuuaaaaucaggaaacauauuuuugcuccuuugugcacuggcuuacaauuuugucauucauaaaaccuugcuagucacuuaauagcaguauuugaacaauuuuaaucacaaaaccagguuacagcuuguggacucucuugcacuacugugacauguacaug

SEQ ID NO: 1621 - RNA, 309 nt, Oryza sativa
guuugaauacauuagagguacuuacggagaagaacagaaaaacagggcacuugguagaauuccucuuagcuauccuguuagcauccuugaaugcaauguccaguuugcuguuuccacuagaagaacuugaccauacaccauacuugauugauuuauggacaucaucuucaccaauugacuugauaacaaagaacuuugcaaagggauaguccacucggagaucaucacuguuauauugguugcaucguauaacaauagucccuucuggaucaccaacagagagccuugauguguaggauuuugcgauua

SEQ ID NO: 1622 - RNA, 150 nt, Oryza sativa
guauaaaagggacucugcuguuuuacucgacgacaugggacuuggcugcacggcgugagcaccuaguucucuucuuagaaaggcagcaugcacagccuucaagcagcucgagguccucaucgcaggucagaauagaagccagcucggggu

SEQ ID NO: 1623 - RNA, 75 nt, Oryza sativa
auggccacugcgcacggcgucgccggcggcaccucuaagaacgcccccgccgccgacgcugccgccguggccacg

SEQ ID NO: 1624 - RNA, 84 nt, Oryza sativa
gaguggaugggacacauccuaauacugugaaucuggacaaacacauguccagauucguaguagcagaaagugucccauccacuc

SEQ ID NO: 1625 - RNA, 311 nt, Oryza sativa
gugcugcgucgagccggugucgugguugucgacgaaggucgucgccuuggccggccaccacccgaucaugccgggcgccuugccguccucgccgcggaggcgccacagcucgaucgcucuccacggcgacguugaggaugcccuugguggugaagucgaacgccguggcauugcuguuggcgccgccgacacgauugacccaguugaccagcuccugccggugcgcguucuggucguaguucggcuugccguccccgccguucgccaucgacguccauaucucggccacggcgaagcucggcucgguggca

SEQ ID NO: 1626 - RNA, 103 nt, Oryza sativa
ccucugcccuaagucaggugacuuuaccgucacugacauguggguccauagcaaagaggacccacauaccagugacucaaagucauguggcuuaagucagagg

SEQ ID NO: 1627 - RNA, 288 nt, Oryza sativa
acgcagcgugucgagugguaacgauuuaugaucuaauacuugcaugguuucugguuuacgcgguagaaaauuuugauuuaugcuaucguagccuacgcguauuccaucagguugugcaucacugccuacuccgcugauagcugcuccacuuccacgaccgucucugaaccaacgcagcuccacgcccucggcuaaucaucuggaacaucugccugaaagcaagguaaucccuguagauauugcgaucuacuaagacauaagugcuaagccuaacaugaucacccuaau

SEQ ID NO: 1628 - RNA, 295 nt, Oryza sativa
ugaacuuuuuuauucuggucaaaaaacaucgcacuaguggggggcucaauauaugccaauauuggcauuaauucacaaaagaucgucgcgcgaaucacgaagugaguuuuuuccacgaacgaacccaguacacuccaauauguccaaaaaucauguuuuugugcuuuuuguacuuuuucaauccgguaaaaaauaucgcacccgugggggcucaacauaugccaauauucgcauuaauugacaaaaguucgucgcacgaaucacgaagugaguuuuuaccaugaaagcacccaau

SEQ ID NO: 1629 - RNA, 217 nt, Oryza sativa
uuguuuaauguaugacgcuguugaccuuuugagauacauuugacuauucgucuuauuaaauauauauauacauauauuauuuauuuuauuaugacuugauuuaugaucaaaugcuuuuuaaggaugauuuaaauuuuuuuaauauuugcacaaaaauuugaauaaaacgaauggucaaacauugauuaaaaagucaacgacaucauauauuaaaaaa

SEQ ID NO: 1630 - RNA, 63 nt, Oryza sativa
accuccccccggcugcucgucgcucagcgcuuugcgcuggcguggacguggccggggugcgac

SEQ ID NO: 1631 - RNA, 280 nt, Oryza sativa
uuuuugcuuuucuuuucucguguguuuuuugccuuuuuuuacaauuauuuucucacguguuuuuuuuacuuguuuuuucuucaaauguucuuuuuuuuuuugcuuuuuuccaauacaggacuuaggggaaacuuuuuuuaaugcaccuuuuugcuuuuucugcuuuuguucucucuuuuauuauuauuuuuuaucaaaaacgaccucaaauaccuuauuguaagauuauagggacucaaauguaaauauaaaaauuacagggacuagaaugcaaaaguac

SEQ ID NO: 1632 - RNA, 300 nt, Oryza sativa
uacugcacagugucaacaagcuguaugcacaguuuuagcacaacuuacuuaugccugguaaggagacugguaguucgcauauccaacccccaagucagauugcugcucauucacuuucuugaacuccgccuucagacgucucuccagcucagucuucuucuucuccagggcggauuucuucaccucuagaagacggagauuaguauuccaaaccgcccucugagcacgcuugucacgagaaacugcgucauuucucucugcaucuguaguguaugccgcuugauaugggacucguuguug

SEQ ID NO: 1633 - RNA, 73 nt, Oryza sativa
guggacaugcggcagcgucgucgucggcggcgcgggcgagcugccgccgccgccgcugcugccgcacauggac

SEQ ID NO: 1634 - RNA, 186 nt, Oryza sativa
gcaccugcuuuggcguuggcguuggcggcggcgacgacuacuaccgaggcuacaccaccguggccaccgacgagacaggccgcaaagccaacaacgacgucgcaagaaaacccgucaccgccgccgccgccgcaacgagggaugucuacggccgcgccgccgaccagccgucgccgaagccgccgg

SEQ ID NO: 1635 - RNA, 224 nt, Oryza sativa
cauguaguaauacuauacuauuacuuguuacuacuugucguuacuacaaucgcaucacgauguuacuguaagugugcaguaaacacuauaaguucaguaacaaugcguuuugcuguauuuuuuggauaguguuacugcacaaacacgugguaacguguaccugccgugcaguaacacuuuuacuuuugugcaguaacaaguauaugguuaguauaugacacuuu

SEQ ID NO: 1636 - RNA, 307 nt, Oryza sativa
cucuaugcuauggauuguaauuacuaguucuaggguucuaggucaauugauuugcuagauuugaugaugccuauaugcccaugaugaaugaaugcucagaugaauaaaccuaugaauuuuauuacugaaauuaaaaccacacuaacuugauuauauccuuauauaugcuuaugaaugaauugaaugaaugagugcgcauauaaacagauuaaugacauaguuaugcaauaauuuaauuuccacuaacaugauuauguucuuauacaugcugacauuuagaaguaacugaaauuaugaaauaguaaca

SEQ ID NO: 1637 - RNA, 284 nt, Oryza sativa
gggacccaugucagucucugcuaaccuucuuccuucucuuccaccacauuuuuccccacccauacaucucucuucuuccucauguacugcugccuccuccccacgcccucuaccucggacggcgguggucguggcagaggucacggugggcgacgucaggagggcgacggucacgaaggacggcgcggaggacagcggcggucacggaggauggcggcggccgacggcgcgggggacaacggcggucguggaggacggugguggucgcggcuggcgacgacgcc

SEQ ID NO: 1638 - RNA, 309 nt, Oryza sativa
cagcuccccauccccgccgccuccucuccucucucuccccaaccccccuccucccaccuccuccacugaucaauccaagaacgcccccuuuucccgguccaagaacucaaaaccacacaaccccccggaaugaaucgggagacagcgcgagauucucccuccuccccgaccccgaccgcgagcgccugcggcggcugcugcuccuccuccgccgaggcgggaggucuccgugcuuguguggaggaggggggggagugggggaggaggaaguggaaaagggcaaaggaggaggaggaggagguggaggug

SEQ ID NO: 1639 - RNA, 301 nt, Oryza sativa
aagagacaggggauuggaggacgacgaaggagggaggagguguguguguacggacaugcugccgucggggcggccgaggagcuugaugggcgugccggaggagcgcggcgggacgacgcaguucuccgggagcucgucggcgcugaggaucuggccgggccaccaggauccguugcggcggcgcacccacacgagcgccccgaccuccgcgucccgccccgucacgccgucgggccacucgcuguccgccgcucccgcgccgcagcuccccauccccgccgccuccucuccucucucuccc

SEQ ID NO: 1640 - RNA, 85 nt, Oryza sativa
uaauuaaguucgccgucggccgccgccgccgccgccuuggugacgaacacgguggggcagggcguccugcaggugcagcaccggu

SEQ ID NO: 1641 - RNA, 274 nt, Oryza sativa
caguaaguauaaaaguaauuuauauauauuauagaaguaacuuagaacaaaacgaagguaacuuugacaugucauuugaaguaaaucuguuguagagauaaaaacaugacucuaucuagaaauuaaauuaaucagcacaaauuauggaauuaacuaaaaagucauauuuuauccccuacaacgaauuuacuucuaaugucgugacaaaguuacuucuguuguauuuuaaguuacuuuuagaauauauguaaauuacuuuuagauuuuauugaau

SEQ ID NO: 1642 - RNA, 121 nt, Oryza sativa
acuucuuccguucuaaaauguugcuaucuaggauuugauuugacccaucauguccagauucguuguucuaggaugggucaaauucuauucuagguagcaacauuuugggacagaggaagua

SEQ ID NO: 1643 - RNA, 122 nt, Oryza sativa
uaaugaguacucccuccguccccaaaaaaaaaaacaacuucuggcuauguaucuagacauaggcuaugucuagauacauagccagaaguuggcuuuuuuugggauggagggaguagucggua

SEQ ID NO: 1644 - RNA, 63 nt, Oryza sativa
guggcgcccaugcgguagccaugcguugaagguuuucgauggugguggcugcggagugugcag

SEQ ID NO: 1645 - RNA, 89 nt, Oryza sativa
uaugcuugggcuuagggugcaucuauuaaauaaacaauucuuggcucugugguuuuuuuuagagaugcacuugauagugcauagugcag

SEQ ID NO: 1646 - RNA, 160 nt, Oryza sativa
uguacuucaguuugucucuccaaacuaauuaguccaaugaacuucugauuacaaaugaguaaccacuaacuucugaguucugauuauggagauauaacuauugcaauuucuuuccaaaguucauugcacuaaucaguuuggggagacaaacugaaaugca

SEQ ID NO: 1647 - RNA, 160 nt, Oryza sativa
uccuauuuuaagugcaacuauaaguuuucgugccaaaaacuuuaaucgucugucuuauuugaaauguuuuuauaauuaguauuuuuauuguuaugagaugauaaauaagauagacgaucaaaauugggcacggaaaaucauggcugcacuuaaaugggac

SEQ ID NO: 1648 - RNA, 112 nt, Oryza sativa
ccuaauaaccgcauuuaaauguugucaaauuuuuggcaugguucauuugaaaugucaauuucccuuuguugaaacagccaauucaacaacaaguuaugaugcguuauaaaua

SEQ ID NO: 1649 - RNA, 311 nt, Oryza sativa
aaagacauucuaaaaaacugguaauuugcuagaggacacuuucggcucaauugaagagauggauuccuaaaaaagacgagaaugccccucuagccacaugcuucaaacaugguguuagaguaaaaauuuggaaauuauguaacucuaaauuugccauagcccaaaguacaucacuagcauacaccauuauuuuauuuucacuuuagucucggcucaaaaagcuuuugacccuagggucauucuugucuuuuugaaaaaaauuucucuccgauugagccggaaguguccuccagcaaauuaccuuuuuuuuu

SEQ ID NO: 1650 - RNA, 105 nt, Oryza sativa
agucuguguguugacguuguuaguguguggguagugguauauuacgaucuuuuagaguuguaaucuuauaauuuucuuaugcucuaucaauaaaaccgcgcuaaa

SEQ ID NO: 1651 - RNA, 176 nt, Oryza sativa
uaaaaauacauguguuuauuugucaaggcccacuguagaagaaggccagcaugaguggaugccuagaagauuuuuuuuucuuuuuccuuuuugcaugacauggcugacuaacgucaagugccuccauaagcugauggaacauuuugcugggucuugcaagaaacauuugcuugcuc

SEQ ID NO: 1652 - RNA, 274 nt, Oryza sativa
ggcggaggagcggcggcgggcgagcgcggcggugggcaaagcagcggagggcgagcuaggcgaagcggaagacaguggaugggacggggagcucccccgugcucggccgccaccaacgcugugcccccgcggguggccgacgaugcuagaagaggcaccaccggugggagaagaggaagaggcagaggaagagauuguuucuuggucgccggccgccucccccucccucccaaacucgcuggccgccgcgcucgcucgccgccgcuccgccgcc

SEQ ID NO: 1653 - RNA, 248 nt, Oryza sativa
gccggcgcagagcuccaugacgagguggacggacugcuuguccucguaggcgcccuugagcuccaccacguugggcugcccggcgaggugguacaugaucugcaccucccgccgcacguccuccacguccuccuugguggacagcuuccgcuuggcgauggucuugcacgcgaacuucugccccgucgccuugugggugcacagggaggugacgccgaacugcccgcgcccgagcuccuugccgaugg

SEQ ID NO: 1654 - RNA, 300 nt, Oryza sativa
cgauuuugugucuccuagcgcugaggugguucgagaagcuuugccauuagaaugaacccagguacucuuuucuacuacuuauuuuucaucacucuuucuucucugguguuuauuucugccauuucaccuuguuaacuauacuaaguucuuggauuuugaugaugacuuuuugcauggucaaucuagauaaauacacacaugacuacaggccaccuugguggaugcaaacaccuuucuuuguucuuucuaguucuugcagauuaauucauacuccuugcagauuguggagaaguauuuuuu

SEQ ID NO: 1655 - RNA, 87 nt, Oryza sativa
aaacaaaaaggucugggugguguaguuggugaucacguuagucucacacacuaaaggucuccaguucgaaccuggacuuagacacag

SEQ ID NO: 1656 - RNA, 299 nt, Oryza sativa
ggacucugggugggcaggccggccgacggguuggggaggaagccgacggggcgaggcgggagaggaggagguucggcgguggcaggcaggcgacaggcggagcggaggcagccucccccacgccauggacgacgacggcgauggcagccuugcuauccccaucccgcuccccaucggcgccauccgccuccgcucucuccucuccccgcucuuguccucucucugcccucuaaauggucgacgucgacagccgccugccggugcggcccgaccuccugcgccccugccgccgcagcccc

SEQ ID NO: 1657 - RNA, 75 nt, Oryza sativa
gguuaggguuccggcggcggaggaggaggagaugggugugccggcguucuaccgguggcuggcggagaaguaccc

SEQ ID NO: 1658 - RNA, 132 nt, Oryza sativa
uuuguucugguccaacaaaaaguaccucgagguaccgguaccccacgguaccaaaucgaaccaacgaucggaaacaauuuaguaacgugagguaccgauaccucgagguacuuuuugcuggacuggagcaaa

SEQ ID NO: 1659 - RNA, 299 nt, Oryza sativa
cucuaguaggcuaagaugguugggcuauauauuauguauggguauaggcuauuacucuaucuucuguguuuuuuaucguuuuguuggacuaugugugucauuuggacccuucguggucuuguaauagccuaaguuucuuuugugagccgucucacauuauccauaagggcucacaaaagaaacuuaggcuauuagaagaccacgaaggguccaaaugacacaccuaguccacacacaagauagaguaauagcccauacccauacauaauauauagccuaaccaucuuagccuacuagau

SEQ ID NO: 1660 - RNA, 184 nt, Oryza sativa
uuuuuuuauuugcuugcaggaauaagguuaaucuauaccggcaagaucaacaacccacgaaaagguguaucgaucguuaaggcguaacacaacaacgucucguacgguuguagucaggucguaaacguuucucccauaucguacggguguagaucaaccuuguucccgcaagcaaaucgaagaa

SEQ ID NO: 1661 - RNA, 143 nt, Oryza sativa
uuccuccguccuauaauauagcaacuuaauaccagauaggacauuucauauuacaaugaaucuagacacucuucugucuagauucgauauacuauaaaauauccaauccaaauacuagguugcuauauuaugggacagaggga

SEQ ID NO: 1662 - RNA, 271 nt, Oryza sativa
ucaugacgccgccgccgccgccggucgccgcuccucucagcauauucaccagacgcgccuugagccuuuccacccuugugcgcugcugcugcugcaggcgcgcgcccucguacuccucgcggaagaggucguuggcgcaggcgacauggaucuggacgacaccggcgccgccgccgccgucggagacguacccccaggugugccuccugucgccgagcuugacgugccugcacuugcagcacggcgaccugagcuuccgcgugagccgcag

SEQ ID NO: 1663 - RNA, 309 nt, Oryza sativa
ccaucaaucucgaugcugugucucagcaguauuuuaaaugguccacggcaugcaaugcuuagucagcgagauguguacaucaauuagcagaaaaaugcauagccagguaacucuuuauaaucgaccugggcaaaccagcguacgugcauaugcuaauuucugauacagcuuuguuauuucuauauauaacgcauaauaauacuuauacaaaucaucguacaaauaacagucuugguuauuauacacuacuuauaaaauuguuuggaugacagggcaaccaguugagauggccgaguuggucuaaggcgc

SEQ ID NO: 1664 - RNA, 310 nt, Oryza sativa
uuuaacuacacaucacgauccagcaguuauggucaccaagcgaaacgacauaucuacgagcuaaaaauaaauuaugaauaaaacacacacauauauauauauauauauauuaauaauuuaaaaguaaaggcugaaaaauaauuuuggacgaaagaacaauauaaucaacucaaauuuaagggggaggaaagaugaggccgcaauaguuaguuguagaugauuuuuguucgccuucagucauauaagcgcccguggccuaauggauaaggcgucugacuucuaaucaggcgauuguggguucgagucccac

SEQ ID NO: 1665 - RNA, 220 nt, Oryza sativa
cuucgcgugaaucaaacaccacaagaaggggagggcauucuccccuuuuuugcaugguucugcaaaguucuauaguuuccuuauccucuuuuggaagaaucuagaaauugaagaguguaucauuaucuaccaaagggccaacaaaauaaaauuguuugcauuaaacgacuugcuaaccugcaugccaccuucuuccaguguagcuugauuacacgaucuc

SEQ ID NO: 1666 - RNA, 99 nt, Oryza sativa
gugggaguuguaggaauggaugcguagagaaagaaaugaaaucugaaccagauuugugauuugauucuuuccuaugacguccauuccaaugauuuccag

SEQ ID NO: 1667 - RNA, 167 nt, Oryza sativa
ccuccgcucuggccuccgccgccgccgccggggauggcccucuaugcgcgacggccgccgcccuccgccaccgccgcccggccgccuccccucccggauccgacggaggggaggccgccgccgccgcccggccgccucccgccgccggaggggagccggaggggagg

SEQ ID NO: 1668 - RNA, 75 nt, Oryza sativa
aagcuuguagcacguucuccccauagcgccacauuuaagauuguaucgcuauggaauggauguaguaaaaaagug

SEQ ID NO: 1669 - RNA, 307 nt, Oryza sativa
ggggauagccucuugucagguugcaggaugaacaucucgcccauuggggcguacaagagcuucugcagugaaauccacagagaggguuacaaccauuguuggucaauuuugguaacaugcaaacaaagugaacauuuuacaaacaagaaaacuaaguggugaugggugaugacuauaagagcugcauauugcaguacucaguaaagauccaaguguucuuugccaauauuuuuuuuaacuacuuuuacuuuuguuuuaaaaagaaguguuguuuuucagucccugaaaaugugacagccaggacauc

SEQ ID NO: 1670 - RNA, 64 nt, Oryza sativa
caaacacguucuccuauugugccccuucgcaacugcugugugggacgaagugagaucaacuuuc

SEQ ID NO: 1671 - RNA, 107 nt, Oryza sativa
uaguguuauuuguaaagagaaaaccagcuuccagaucucgaauuugccucaaacuuaucuucucuuguagaucuggaagcuagguuuucucuuuacaaauaacacua

SEQ ID NO: 1672 - RNA, 74 nt, Oryza sativa
uuauccuaaugagccgagucgagucgagccgagccugcuacgagccgagcgagcuaacgagcuucgaguuuucc

SEQ ID NO: 1673 - RNA, 217 nt, Oryza sativa
auguaacacaucauaauacuacgaauuuggacaaacccccuauccagauucguaguauuagaaugugucacaucccuccgaaauuccuuauauuaaaagacggauggaguauuacucuugauauauaaaggauuuugaagggaugugacacauccuaauacuacgaaucuggacagauuccuauccauauucguaguauaauuaugauguguaauau

SEQ ID NO: 1674 - RNA, 236 nt, Oryza sativa
cccuccuacuacccgccacccccgccgccggucgucacccccacgccgcagugcccgccgccaccuuccuaccccuccggcggaggcgguggcggaggcggaggcaccgucauguacaccucgccgccaccucccuacagcggcgguggaggcggcagcagcaccggcgguggaggcaucuacuaccccccgcccaccgguggaggcggcggcggcgguggcggcuggcagcaggg

SEQ ID NO: 1675 - RNA, 91 nt, Oryza sativa
uguagauuggucugaccgagguugauccgccagucugaccgcgccggugcuauaagucugacugguguagauugcccggucuaaucgucac

SEQ ID NO: 1676 - RNA, 311 nt, Oryza sativa
gagauggcauucccucauuauuugcaugucauccaaaugauuaagaaaaaaaaucaaccagguauauuaauaugugauaaauuauuccacaaauaugcaaggucaaauuuaacuucuauaaguuugaaugaaaaaaauaaauuugauuaagaauauucguuaacuagccauaguuuauuuuuuuauaaccuguaaaaguuaaauuuuaacuugcauauuuguggagugauuuauuauauauuaaucuaucuuguuaaauuuuuuuaaaaaaauucauaacuauuuggauaacauguaaauaacuagaggau

SEQ ID NO: 1677 - RNA, 111 nt, Oryza sativa
auauauacuauuugguagucuaggaagcgugcgugcgaagaauaaggauuuccccaaucuaaaggucuauuuguaaaauacauguuucuagaaggacuaaaaugugcagaa

SEQ ID NO: 1678 - RNA, 135 nt, Oryza sativa
cuucaauagguuagugcguuuugcaaauucgcaggcccuaucuugugguaugaacugaguacgcgaugauuuauccugcguauugggggcuuaccauaagauaaagccgugaauuugcaaaacguucaaacccac

SEQ ID NO: 1679 - RNA, 120 nt, Oryza sativa
aaauauuagguaaaggguggcccaaagugaaacuuugguaaugaaagguggagugaauugcaaucugggccauauauuuuauuacccaaguuucacucuggaccacccuuaaaccaaucu

SEQ ID NO: 1680 - RNA, 161 nt, Oryza sativa
uccuuggacuucucggagucaaaccgcuuguuauugccgguaaugaacucuuucggcacaccgaaucaacagaaaauguuuuuccaaauggauuuuuacacuagugccgaagguacuaccuuagcccaucgaaugcggcuugacacucagguguccaauug

SEQ ID NO: 1681 - RNA, 281 nt, Oryza sativa
ucgauucacgucaccgguggcugccccggaugcugcgcugcacgcccccucugggcccgagaggcgccggcggcagcggauccaccgcucccgcgccuggcagcgguggagacggaugccggcauggcaagcggcgaagggggaggaagccggcgcggugagcggcgcccggcggcggcgaagacggaggccggcgcccagcagcggcggagacagaggccggcggucucaucugcaguagcgccucgcgugugguggcggcuuaucugauuuggaucggc

SEQ ID NO: 1682 - RNA, 110 nt, Oryza sativa
acuacuacauccguuccaaaauauaaccacuuuuagcuacgaaucuagacacacgguugucuagauucauagcuaaaaaugcuuacauuuugagacggagggaguaguac

SEQ ID NO: 1683 - RNA, 101 nt, Oryza sativa
cuucauccacuuucacgcugaccaaucaauugccacaccuagcgcgcucuuccacucagguccgaugcccugauccgugcagcuuggaagacccaccguga

SEQ ID NO: 1684 - RNA, 311 nt, Oryza sativa
aaucguugauuaguuaaaaauugacccggucucggacuuaauaguuauuuuguucgaaauaaaccguuccgccuuuuucuacgcgcggucgaccggaaaucguucauuaguuaaaaacugauccgcgcccggacuuaauaguuauuuuguucgaaauaaaccguuucgcuuuauucuacgcgcggucgaccggaaaucauugauuaguuaaaaauugacgcgccccggacuucauagauauuuuguucgagauaauccgcuccgcuuuauuauaugcgcggucgaccggaaaucauugauuaguuaaaaau

SEQ ID NO: 1685 - RNA, 294 nt, Oryza sativa
cgucgcguucuguccacaucgcauugugccacgcucccccgccuccucgcugcgucgcgcucccacgccacgcccucgcgcgccccggcgccgcgucgcgccucucucgccccgucgugaccacgcugccucuccgccauguccaccgaauccucuucuuccucuacaaccucgggaacgauggcaucuacauccuccggcuccucuucaaccucugcugccaacgucggagauucuaccggcgugauuuucgccaacccguaugccacagucaaugucaagacccacguaccc

SEQ ID NO: 1686 - RNA, 83 nt, Oryza sativa
cgguaugucaugagacccuucgaccagaccugcugaaaccaugugaccagcgaggcuucaggcucgaggcgucaaguucaucg

SEQ ID NO: 1687 - RNA, 72 nt, Oryza sativa
aguuugcaguuguggcacugacauaugggccagacacauuuggcccacauguuagugccacaacugcaaacu

SEQ ID NO: 1688 - RNA, 120 nt, Oryza sativa
uggaauucuucauugauuuauucaugagagaaucuauucuauacaacuaaguuuguuauaguucaacaauuuaccacugacuuugucucuuucuacaauauaucggugacuuuaucaauu

SEQ ID NO: 1689 - RNA, 310 nt, Oryza sativa
ccgccuccccucguuuacuauuggucgccgauuaacccccucuucuccuccucagcgccgccgugccaagaagccgccgccgcgccgccgugcugagaagccgugcgccugccgggacucguugucgccgugugccgccgcgccgccgugcugagaagccgugcgccgugcgccugccgggacucgucguacccccucuccagguaccccucucucucugaugcccaugaauggaauggugcaguggauggaugaauaaaugaugcaauggaauggaugaaugaaugaugaacuuuggaugaaugaugaa

SEQ ID NO: 1690 - RNA, 90 nt, Oryza sativa
uauuauugcaugcggcugcuuaagauggccacaugcgaaaauaggccuauuauugcaugccgcucucuuaagcagccgcaugcgauaaug

SEQ ID NO: 1691 - RNA, 213 nt, Oryza sativa
aauaucagagaggggagagagagagaggagagaggagaagagaugaaaaauuuugaagugguguggagggaaaaaauuaaucuaaaauuaugagaacuucgaaucaaauuuuaugauauuaaaugaacucauaugaaaaaguuaccaaaaauaaaguuguagaacucguuaagaucuaccaauuuucuuuuggucauuucuccauccgaguuu

SEQ ID NO: 1692 - RNA, 199 nt, Oryza sativa
ugccccaccgucgccaccuucaucuccccgucuccaucgccucauccucuuccccaacacuuuuaucucuuucucuccacauauagaucaaucaugcgacaaauuagcucgaucuauagauggaucuuagcggcauugucgaucugugcccaggaugaggagaucgggguuggggagaugaggaggcgacaacugcgug

SEQ ID NO: 1693 - RNA, 143 nt, Oryza sativa
ugcagucgccuccaccaccguugcaucggccaacggggaggccggaggcuucgaaucuggccaccccggccuccccguuaauggauucagcuggccggagugggucgauccaggcgaugacgacgacgagggaggguggcggg

SEQ ID NO: 1694 - RNA, 85 nt, Oryza sativa
ucacgggucuuaucuugugguaugaacugaguacguaaugauuuauggugcauauugggggcuuaccauaagauaaugccaugaa

SEQ ID NO: 1695 - RNA, 72 nt, Oryza sativa
cuccucccccuccccgccgccuccucuccaggcggccgagcccaggcgugggcggcgggcggaugggagggu

SEQ ID NO: 1696 - RNA, 88 nt, Oryza sativa
guacucccuccgucccgaaauaaccaaaccucguaggacaugucacauccuaguacgagguugguuuauuuugggacggagggaguau

SEQ ID NO: 1697 - RNA, 117 nt, Oryza sativa
cucgcugcggaggaugaagacgacgccgacgccguacgcgaacgauagcgaggucgcggcccgccucgcucguaucgcguacggcgucggcgucgucuuuauucucauccucgcguc

SEQ ID NO: 1698 - RNA, 82 nt, Oryza sativa
accagauaugacauuucauaguacaauaaaucugaacaaggaauguccugauucauugugcuaugaaauaucucaucugaug

SEQ ID NO: 1699 - RNA, 147 nt, Oryza sativa
aaaggcgcauuugcaaauuugccacuguuuuuuucaauuuugcaaggauaccacucgaaugauaguucuagugguauuuuugcaauuuucuaguggcagucuuacaauaacgauucaaagcagugguaaauuugcaauugccccaau

SEQ ID NO: 1700 - RNA, 159 nt, Oryza sativa
aaauuagggauagggaauuugcuaggugugaugcggaugcagauuauuuuccaaugccuacaucaccucacucugacuggccagaagaugaaccucuuguugaggauagcaacaugaauuucuuccgcgaugacuuggcaaaugcuuuguuuaauggau

SEQ ID NO: 1701 - RNA, 90 nt, Oryza sativa
gcacgcgcgcgagaucgaggaggaggaggcgcaugggaucaguuaauaaauucuaucuccuccucucucaccuuuaucucuuucuccucu

SEQ ID NO: 1702 - RNA, 251 nt, Oryza sativa
auuacugaaguuuugcuuuggacuguguaaucuuaccuuucuugcacuuuggaccacuccgacucucuucucaagcauaugaacgauuucgaguaugcuggcuccuacucgucaaggaacuccugcaucuauaugcagaccauuuuuuuuuuacauacuacaaguuggacguagauggguaaaagaguuaacggugguucaaagugccacaaagguaagauuacccaguccaaagugaaaacauugguuaa

SEQ ID NO: 1703 - RNA, 177 nt, Oryza sativa
acaugugagucaagauagguccaugccuaaacuagcuugcagauggaggugacagcaccauuuuaacgugcagaauaacaaaaagaauagaggccaaucacuaaauuaggcauauugauuacuauguaaaccagcugcuagcuagcuuggguuugggccuaacuugaaucacuugcu

SEQ ID NO: 1704 - RNA, 70 nt, Oryza sativa
acaagaugaaagagcaaguugaggucuuggagaagaagaauaaagaacucgaacuugccugcaaaaauca

SEQ ID NO: 1705 - RNA, 203 nt, Oryza sativa
auaaguguagccaugaguuuucaugucuaacuuuuaucuuccgucuuauuugaauuuuuuaugauuaauauuucuauuguuauuagauuauaaaacauuacuaguacauuaugcgugacuuauguuuuuuuaguuuuuuuaaaaaaaaaauuaaauaagauggacgauuaaaauuggacacagaaacucguggcugcacuuau

SEQ ID NO: 1706 - RNA, 63 nt, Oryza sativa
aacaauggaaagacaguguucaacggcgagcuucgccgcggacagcugcuuauuauaccacaa

SEQ ID NO: 1707 - RNA, 119 nt, Oryza sativa
agcuaccaagacguuuauaaugcggcagaauccucuuaggucggcuugcggauaaagaauaacuaaauaaauaaauugcaagcaauuguuuugcugcuauguacuguccagucuuucga

SEQ ID NO: 1708 - RNA, 268 nt, Oryza sativa
ccacgcgccccgccagccccgucgucguggcugcuccgacgucgaucgccugcgucgccgucgucgccagcauccgcgccgccacgccguugcucaugucgaggaacgucgcguacagguugucgcugaacggcaggacgucuccggugacgagccaccgguggaacuccccccgcugggcgacgucgucauguuggugucggcggcgagguagcaguagcacccgucgagccaggcgccggcgcggcggcuggcggcgccgcagccu

SEQ ID NO: 1709 - RNA, 157 nt, Oryza sativa
agccaggcgccggcgcggcggcuggcggcgccgcagccugcgacgacguccgcgacugcggcggcgaggcucucgcgguacugcgccggcgcagagucgccgaggcagacgcugagagcgagcgcgcggucgucgccgucgccggccugcguggagg

SEQ ID NO: 1710 - RNA, 225 nt, Oryza sativa
ggcggggaacccacucgcgccaccggcggcgcccuccgccgcuugaccucgcaccccggcggcagaggcggcagcccaggauggcacaugcuccggcaccaaagcccucacggcgaagaagcuagucuaguuucuucuccacguauuauaagaacagcaaccgggauggaaucggguucugguguuuucggaugguggcuggcuggcugcgagagguuaaagaga

SEQ ID NO: 1711 - RNA, 310 nt, Oryza sativa
cgcaaccaccuucgcgggggguauacugcugauggaguugcuaccaccgcuucuaucgccacgugucuaggguuuggguuuugauacgaagggcgugagguggucuagucgaaugaggaacggguuugguuuaagggcauuauggucauuuuaugaauuucucucuccaaaauaguuuaaauaauaauaauaaaauagugggugcucugucuacgggaaaaauaaacauguuuuucagguauccacaagcuaagccacauuuugccuuuuucaaaaggaauaugcauuguagccuugaagcuugaaggug

SEQ ID NO: 1712 - RNA, 131 nt, Oryza sativa
gaucauccacagccaucacauuccuauagaaaacaagcaaacacauaguauggggguguuuacaucagggacguaaaguuuuagcauguuauaucagguauuacauagggugucgcaugguguguucggau

SEQ ID NO: 1713 - RNA, 287 nt, Oryza sativa
ugagcaaguauauauagucuuaguuucuguagacuucuguccugcguggauguuuucuccuuuugcagugaugcaucuugcuugcauuccauuuccuguuucucuuauaucuaguuauugcccucgguggcuuaauuaauguucagugucgaugauuccuguuuugguuauaaguaucaacaaguugaccuaugcccauuaugcacauucugauuacgugcagcuuugagaagaacccacgcuuggaagguccagaacuacaaggccuggcuguauaugacaccaac

SEQ ID NO: 1714 - RNA, 300 nt, Oryza sativa
uccaugcguuugggcaauuuuuccaucgccagugcaugcagucaaugcuucccaacaucccagggaauccacgagacucuccaacuuggagcaaacgcucgagauccucagccguggggcgacgcagguaccuacuacuaaauaccucgacgacaccuuccacaaaauuuucuaagcacucuagagcaguacucuggggaaccuucaaguacucaucaagagcgucagcagcagucccauaugcaagcauacggaucgcugcagugcacuucugcaauggugagugcccaaggcguccag

SEQ ID NO: 1715 - RNA, 69 nt, Oryza sativa
acaugcgaggugguaggcgaggaccggcggcggagaagcagcgccgggagcucguccccccagucgacg

SEQ ID NO: 1716 - RNA, 65 nt, Oryza sativa
aagggccuugugacaauugaggauuuuguauaacuaaagucguccacauuuuacgaacagacaau

SEQ ID NO: 1717 - RNA, 311 nt, Oryza sativa
aaagacacuuuaaaaaacugguaauuugcuagagaacauuuuggacucaauuggggagagaaauucuucaaaaagagaagaauacccuaaggucaaaagcuuuugagcuaagacuguagcaaagauggaguauaauguaugcuagugguguauuuagggugacgguaaauuuagauuugcauaauuucuaaucuuuuacuuuaaugucauguuugaagggcgugguauuagggucauucucgucuuuuuaaagaaauuaucaauccaauuaagccgaaagugucuucuaucaaauuaucaguuuuuuacua

SEQ ID NO: 1718 - RNA, 274 nt, Oryza sativa
uuacgcugucugcgccagugucgagucacagguaacuacucccuccaucccaaaaucccaaccuaguauuaaauaagacguuuuuuauacauaaguaugucugauuuguuguuuuagaaaguaucacaucuaauacuagauugguuuuuuuggccggagagagcacaccugaaaaaaaaaucagaucaagcuggaacuucauuguacgagauuuuuuuuuucggggaauuguacgaauuuaaccugaaguugauuacugcugcagauuguaucc

SEQ ID NO: 1719 - RNA, 78 nt, Oryza sativa
cucugucuagaucggcuuuuacuugguuuuccuccuugccauaugguucgaucaacaguugggccgauuuggagaagc

SEQ ID NO: 1720 - RNA, 177 nt, Oryza sativa
agcugauuagguaguguuuggcuaauggguuugagaaaugauuuccaacccaccaaaagacaucuuuaaauccuaaccauuuauuuucccuuuuucauuuaauccuaacccuucauucauuucucaaucccaaucccacuccccauuuccuauuauccaaacacacccuuagugcuu

SEQ ID NO: 1721 - RNA, 114 nt, Oryza sativa
ugccugucccucccaccgagcagccggaucucccagugaguaggcccgggccgccagauccggugaccccggucuccucgccgguguauccggcgccgcagggagggacgagag

SEQ ID NO: 1722 - RNA, 310 nt, Oryza sativa
aguagucgugggacugaucgaguuugcuguuugccgccuuccgacaguugaccuucaugucgccgccgcaguugccuuuugcugaaaauuggauggaaaacgugcaucgagggauggguauuugauugauggauaauuggaugucaucaaacaacaacauggauaauauggagcaugcuggguggcuuaccacuagcuugacucuaggcauugagagacaacacaaacugucaaagauugguggaagacacuagcuaauacggcaugaguuugagagguuugcgcacccucauccuccucaugguuuggg

SEQ ID NO: 1723 - RNA, 74 nt, Oryza sativa
gcuaccauaucaaaauguugguacuaccaaaaccuagacaaguuuugguagugccaaaauuuugguaaccaaac

SEQ ID NO: 1724 - RNA, 98 nt, Oryza sativa
aacucauuuuuccaugcgggcucuuaagugauucgcaugcaaaaacgagcuuauuuuuacauacagaccucuuaagagcccacauggaaaaaaaacga

SEQ ID NO: 1725 - RNA, 145 nt, Oryza sativa
gccaagauucauucaugucaucacggguuaaaauuuaacuccauuaaaauuuuaacuccugaaaguuuacucccaguaaaauuuuaacuccugaguaaaucugcgaguuaaaguuuaacucgugaugucguggaugaaucucagc

SEQ ID NO: 1726 - RNA, 60 nt, Oryza sativa
aaguuuugguauaucauaucggauauuauauaaggugucgcauaggguauucgggcacua

SEQ ID NO: 1727 - RNA, 74 nt, Oryza sativa
caaucuaguaucggaagggauacauccuaguauauucguuguauuaggauacgucucauccgguuuuagguuug

SEQ ID NO: 1728 - RNA, 311 nt, Oryza sativa
gaaaccgacagaaauuucagcugggauucuggcaaaaggcccagauaugauccggugaacacaaacgguucuggcugggcuaccuguccuucuggcgcaguugaauuuaggccuguuugaaugagccucaauccaggcccauaagcaugaggguaagugcuaugauagauaugacuauugucuccaaauuuaucuauuuuauucacucauaaagcaagaggcaacccauacaauguaucaccucuaguuuacaaauaccaauauaucuaauacucucacauccuuuuugaaauuuguguggagguugccuc

SEQ ID NO: 1729 - RNA, 300 nt, Oryza sativa
ccgauucgccgccagcgccagcgccaccgcaucccuccccagcaaugccccgagggcgaggcggagaucggagaggagaggagagagggaaaggaguugggcguaccaaccuugcuggagaucgaucucgugcgcgcgcguggccucucucaucuccuccccaccucgucgagccgaagaaaaaggagacgacgccucgacgcgcggugguugcagcggagggaggcuucgagccgccgcgguggguggacgcggucuacgugagccgggugugguggacuggugguggugguggucuag

SEQ ID NO: 1730 - RNA, 184 nt, Oryza sativa
ggccacgccccgcugcucccccgccgccugcgcccgcccgcgugccgcuccucuccccgccgccacugccgccguuggugucgacgaaacgcuugacgacgcacaugaggucaccggaggcggagcggcguggcgucggugagagagagcgguggcggcggcgggcgagcgcggcugcggaugg

SEQ ID NO: 1731 - RNA, 64 nt, Oryza sativa
uugucaguacucgcaguauaugacauauggacccucaugugucuauaaccuguguguccagucu

SEQ ID NO: 1732 - RNA, 87 nt, Oryza sativa
acuaguaugguggguagggggagcucagggaugagaugauugaugaugauggcaggucagggcucucccuacauacgguguauaaau

SEQ ID NO: 1733 - RNA, 92 nt, Oryza sativa
gauaggaguggaugcggcggcggucacguagcacccuagguuugcggcggauaggggcggaugcggccgaugucucguaccuccugcggauc

SEQ ID NO: 1734 - RNA, 160 nt, Oryza sativa
gcuugcaguguuugaccaaucgucuuauucaaaaaauuuauauaaauauaaaaaaugaaaaauuguguguaaaguacuuuggauaauaaaguaagucacaaaaaaguaaauaauaauuucaauuuuuuuuuaauaagauaaguggucaaacacuauaaac

SEQ ID NO: 1735 - RNA, 63 nt, Oryza sativa
augcauggugauaggcagugaacuuucaaaaaauguaaguagccagccauaucaaucaucucc

SEQ ID NO: 1736 - RNA, 310 nt, Oryza sativa
agacuucucauguaacaccgugcauaccacuaacaauuucacuaaaaaaauuuagaaaaaauuguacaaguauuuccaauauuacugcauaaagucuuaaccucagauucauuauauuuuaaccguaaccaaaaaaagauaaaaauuaugacaguuuuaagaguauaaaucuaucagaaucuugucuuuuuuguugcucuguauauauaaugauuuugaagauuagacuguaauacuaguaaaaguacauguacaguuuuuuuaaaaaaaauuggugaaauuuuuaguuggugugcguguauuuauacga

SEQ ID NO: 1737 - RNA, 161 nt, Oryza sativa
uuagugugaauguguggcucuagugacuagucauucuggaagcugugaacauaaaacagaguagaucaguggaccaaucaucuggcuugugaauccuguccuaggguuuacauuuccuuuuuuuuugcaggggugguuacuaggguuuacauuucugaccg

SEQ ID NO: 1738 - RNA, 88 nt, Oryza sativa
augauuugcauacaugcauguauugccuuuccauauaaacguacucacaucguuuccauauaagcaaacauguacguaauaauuuccu

SEQ ID NO: 1739 - RNA, 129 nt, Oryza sativa
ugcaugauggucugcuucacaaggcugugcgugugcuguauaucugcauggaggugcauauacguuaugcgggucuuuuugccguaugauuccguauauguaugcugcaguugagugggccuauuugau

SEQ ID NO: 1740 - RNA, 146 nt, Oryza sativa
aaucuaccaaaagaaucacacauguagaugagaauucuacacaaccauguaaaauaucuuguccaaacuugacuucguuuggacaagauuuuuuacaugguuguguaguaucaucucaucuacaugugugguucuuuuuuguugaa

SEQ ID NO: 1741 - RNA, 195 nt, Oryza sativa
auuauaucgcucgacgugaccuacaacuuuguaguugaaaaguuuuugaauuaaaacuguuuaggguccuaaaauauuguuguauguuuauagauuuugaaauuuuaauuuuaaaauuacauuuugggacaaaaaaaugacuuacaauaaaaaaaauucaacuacaaaguuguagaccgcgucgagggcuacaag

SEQ ID NO: 1742 - RNA, 161 nt, Oryza sativa
cauuauccugacauaugugacuuugcucaggcuuuaucauuaccacagagauguuaguuuuacuaauuuccaaagauucauuucugaauauuauaucagcuguauuuacaguccgauaugaauauuugcagugggggauugcauacugugucaaagggggg

SEQ ID NO: 1743 - RNA, 68 nt, Oryza sativa
gcagaccacuuaagagauccgccuaaaaaaaccuuuauuuuuguaugcggaccucuuaagugguccau

SEQ ID NO: 1744 - RNA, 296 nt, Oryza sativa
cucccuacuauauaaagggaccuugagaucaaugagaaaugacaacuauuucaugauucacuauuuacauuucuaacacgucaucagcauguagcucuuaccagcugagcaagaaaggugaagaacuuaccgguaacucgaaggguaagauggcucgccauuugccuauuccucuucaccuuucuugcucagcugguuagagcuacgugcugaugacguguuagaaauguagauagugaaucaugaaauagcugucauuucucauuaaucucaaggucccuuuauauaguagggag

SEQ ID NO: 1745 - RNA, 171 nt, Oryza sativa
gguccagucugacuguaaucagggcuuuugggccucgccggugcuucuugugcccugugaccgugugaaccugcuguauuuccgaguuuggaccggagugcuuaccucuagggugcgagaguucuuguguuaaggcggagucggagcugcugcaucgggucagcugaugag

SEQ ID NO: 1746 - RNA, 311 nt, Oryza sativa
gcuccggcgggagauggggagaaaggcgcuaccgcucaugacggcgggagagggggagaggaggcggccgacgcgauggcgccggcgggagagggguggagaggcggucgacgcgacggccggagaggcgggcggcgcaggcgcgacagcucgugauggcgggagaggcaggcggcgcgggcgcggccuccuuucucccccucuccugccggcaccauugcgucguccgccuccucuccuccuucuuccccugcgggcucgcugcgccauccgccgcgccuaccccucucuugccggcgccaucaccgucc

SEQ ID NO: 1747 - RNA, 100 nt, Oryza sativa
gaggaggauuucgcaggggauguuucguucuucuaggaugguucuuacuagggucuacccuagucgguuguaugaaagaucuuuuggguagauuaugcuu

SEQ ID NO: 1748 - RNA, 69 nt, Oryza sativa
ugggcuagauugggccagcuagggguucggccgggguuuggccgaaccuugguuggcuccccuggccca

SEQ ID NO: 1749 - RNA, 102 nt, Oryza sativa
ccaaauagauuuucgcuggcggccgauauaacacagccgccaucgaaaaugaauuuuugcuggcggcuggcuuaagacgaccgccagcgaaaauggauuuuu

SEQ ID NO: 1750 - RNA, 202 nt, Oryza sativa
gagguagguauaggcaugaaauacauucauaccagaucucaaguccaaacuuaacuucauuugagagaaaaaaaaagacaaauuucguaugaauaguguuauguuauuauucaccucaaauuuguuuuuuuguuuuucccaaaugaaguugaguuuggacuugagauuugguaugaauguacuuuauguguauaccuaucuc

SEQ ID NO: 1751 - RNA, 152 nt, Oryza sativa
cuucccaucucucucucuccucucccucacuuggcucccaaggcaccgauccccuagaaaugcuaagggcaaguacuauggacauccaaacacaaucucuuaggugccacauaaguuuaaauagugaggugaaggagagaagagaugagaga

SEQ ID NO: 1752 - RNA, 224 nt, Oryza sativa
uuuuagaaucuugguugaccagccgacuagcugauugauaaauauaauuguguuguuugguccucuuagaauggaaguauuucuggagcuaauacacaguauuaagaaauuagauaaaaauaauuaggaagagauuaugauugguugagaaaagaaauaugugaagaaauaaaauagagaauggaugauuaguugagaugagaggguagaugaagaaauaguuu

SEQ ID NO: 1753 - RNA, 199 nt, Oryza sativa
gggagcaugguggcggggcaggugguguugccggagucgauccagcgcuggauggaggcgcggucguaggugacgccggugcagaggcucaccggcgagcgcaugacgucgagggagauggggcaccggaagaacguggguaccuucaccuccaggcccugguacuccgccgcgagccugccgccgccgccgcccaucu

SEQ ID NO: 1754 - RNA, 152 nt, Oryza sativa
uuguacuccuuccgucccaaaauauaaaggauuuuagauggaugagacacuucauaggauaaugaauuagcauauacuuuuaauucagauucauuguucuauaaaauguuuuauccguccaaacucccuuauauuuucggauacucaaguca

SEQ ID NO: 1755 - RNA, 76 nt, Oryza sativa
cuuguauaagguuagauauggaauuauugcuagucggugaugacguggcaugguugcauauugagcuuuagucuuu

SEQ ID NO: 1756 - RNA, 254 nt, Oryza sativa
cucugggagcggcggagacgguggaaggggaggaggggucgacccggaggugcugccggucacgguguacagccgcgcugcggcggcggcggcggcgaaggaggacggcguggagugcgcggugugccucgcgaagcucgaggacggcgaggaggccagguuccuccgccggugcggccacggcuuccacgccgagugcgucgacauguggcucggcucccacuccaccugcccgcucugccgccucaccgucg

SEQ ID NO: 1757 - RNA, 64 nt, Oryza sativa
gccacccguaucuuaaugacauguagcacucacaugagucaaugacauaugggucaggguggca

SEQ ID NO: 1758 - RNA, 104 nt, Oryza sativa
cuuuaacaguuguuucuuuugagggcugcuggauuuuugcugccaugcuauaucauggcuugggcuauuaguaucaugcaacgucaaagacaaagacagguugg

SEQ ID NO: 1759 - RNA, 95 nt, Oryza sativa
ugcgggaguauaggcacaugguuccuaacuaugauguugcauucaguugcaaacuuugcagcaacaagaggaaccacuggccuuauauucccuuc

SEQ ID NO: 1760 - RNA, 96 nt, Oryza sativa
aacuacuaccuccguuccaaaauauagcaacuuuaggcuaugaaucuaggucauagcuaaaaaaaugcuuacauuuugagacggagagaguaucac

SEQ ID NO: 1761 - RNA, 163 nt, Oryza sativa
cuaccagcagccccgcgcgccgccccgugccccuggacgccgccgccgccgccgugcgccggaaccgcgcgggcgaggagaauccgacggaggagccgaggcgcggcuuggaggaggagguggagaagaccagggagguggaugcggaggcggaggcgaggga

SEQ ID NO: 1762 - RNA, 118 nt, Oryza sativa
guuuuguugcuggucaucuagcuacccgugcaugccuggagauuggagaauaauugacgaugcagcagucggcuuauuggcucuugggcacgcgugguuagaugaccaucagcaaaca

SEQ ID NO: 1763 - RNA, 138 nt, Oryza sativa
ccaugaaccuguuuuguugcuggucaucuagcuacccgugcaugccuggagauuggagaauaauugacgaugcagcagucggcuuauuggcucuugggcacgcgugguuagaugaccaucagcaaacaaguucgugag

SEQ ID NO: 1764 - RNA, 311 nt, Oryza sativa
cauccucucaucaucgcgggugacaaaguuaauggcaacucccuuccugccaaaccgaccacuacgaccaaugcgauggagguaguucucaggcugggugggcaggucguaguugaugacaagggagacuugcuggacaucgauaccacgagcaagcagaucaguggugauaagcacacgggaagaaccagaucggaacucccucaugaugaugucccuaguguucugguccaugucuccauguguggcagagacaguguggucccugcuccucaucuugucggugagccaguccaccuugcggcgggugu

SEQ ID NO: 1765 - RNA, 72 nt, Oryza sativa
acacugccacaucaccuauagcaggcgugaccgauuuguacugacaugcuagcuagagugguguggcaggau

SEQ ID NO: 1766 - RNA, 233 nt, Oryza sativa
uccgacacccacuugccccagcuccgcaugcgcaccccgcgguacgucggguggugcccguccuugcgcggccgcuucuucuugccgccggcgccgucugaggacgacgacgcgguggacggcggggaggccggcgccuccccgcccgaggaggacguggucggcucggaaccgaacgacgagucguccauggcgccgcgcgcugugguggacuggugguggugguggaguug

SEQ ID NO: 1767 - RNA, 310 nt, Oryza sativa
uagcuacucauaccuuucucggccuuuuugcuaagaucaaguguaguaucuguucuuaucaguuuaauaucugauaugugggccauguguccacuuugauauuaaauuuauuuuuugugggggagggcccaccacaguagcuugcugcuggggcucucgcgugucgcccuagcguugcacugcugcuuaggcauggcgcaccccaaccaauccuaaguuugaaauauuuucguuugaucaaaauuuguuguccuggcauggcagaaaaaugaaugauacuugggccgcgauguugaauggcacaaccuuc

SEQ ID NO: 1768 - RNA, 163 nt, Oryza sativa
ggaggaggccguccucaaacccacguggcucuccgcgaggggggaucaagcccuggguggagcgguggcuacccccacccagcuagagggaggaggccgcccucaaacccacguggcucuccccgaggugggucgagcccgggguguuguggcggcugccccc

SEQ ID NO: 1769 - RNA, 72 nt, Oryza sativa
guacagcagcugcacgccguugagccggcaguaauccagcuuguucuucagcagccgugucagcaagcuguc

SEQ ID NO: 1770 - RNA, 73 nt, Oryza sativa
gagggaaggcuuacacuugcugaugcuuugguguacgcuuguaaucaagguguugacaagguaaugacuuuua

SEQ ID NO: 1771 - RNA, 59 nt, Oryza sativa
gaucuauaaauuuacauuuguugcacguauagagugacaaaugagaauauauauaaaaa

SEQ ID NO: 1772 - RNA, 88 nt, Oryza sativa
ugagauggaucaaaugauuucacagguaccugggugccgucggcgucgaggaggcgguacucgugcaugacccaguugguccucuggc

SEQ ID NO: 1773 - RNA, 115 nt, Oryza sativa
cguuggcggcggcgagcauggggguggugacggaggugcuggggagcgacgucgucgacgaggucgaccagcccaucaucgacuacaucgccaacguccucgccgacgaggacuu

SEQ ID NO: 1774 - RNA, 178 nt, Oryza sativa
gccaugcucuccacaggcuuucuugaacugugaacucgugugugcaugcuccucauauauuguucuagaucccaugcaugaugcauaucgaucgaucugaucugaauuaggucaucgaugcgcaucuggauccccaucuuguugauaguucaagaaaguccuuggaaaacauggugcc

SEQ ID NO: 1775 - RNA, 178 nt, Oryza sativa; identical to SEQ ID NO: 1774

SEQ ID NO: 1776 - RNA, 229 nt, Oryza sativa
ugcauuuaccuuggagcauguguaaagcuagcucuugcauaaaagcuaacacccaucauuuuucuuguucuuucuccuccacauagccuuauaguuggcuuagaguccacuauggagcaaguuuaguuaguaggcuauaacucaacuguaagcuuauguggaggagagauaacaagaaaaaugaguguuaugcaagagauagcuauacacaugcuccaagaugaaugca

SEQ ID NO: 1777 - RNA, 88 nt, Oryza sativa
ggcagcgugcucaccggagagaagguggcggccggaggagagagccuucccgucgcugucgccaucgccuccaggucgcgccgcgcgc

SEQ ID NO: 1778 - RNA, 157 nt, Oryza sativa
cacaagacuuugaccaacaauuacucuauuaggauauaauuuuugugacacgaaauugaauuuguuagauucguauucaaaagcacuuaauuaugauuaugcuucuguaucacauaaauaauauccuaauagagcaauugugggucacagccuuguc

SEQ ID NO: 1779 - RNA, 262 nt, Oryza sativa
cguuugaccguggucuugucuacguggcaugcuacguggacgaugacauggacuuuuuuauuuuuucucucuucuuccuuuuuuucucccuucuuaucuuuuuuuuucuccauuuugccuccuuccucucccuuccgccgcaguuuucuccacgcuaggugaggaaggagagaaaagauggggagaaaaaaaagggaaaaagaaaauuuagccaugucaucauccacguggcaugccacauaggcaagaccacggucaaacc

SEQ ID NO: 1780 - RNA, 62 nt, Oryza sativa
auuuuuuuaauccuauguggcacgcuagguguacaaggugugcucacguggauaguuagaug

SEQ ID NO: 1781 - RNA, 308 nt, Oryza sativa
gccgaggcguugcguugugucugcaucucucucugucucucucucgauccuuuugcaauggaccggaauccaaccccgcgagauugccucuguaacgggcaggcaauucaauacgcauugaucgcgucguuacugcggcaacgggcggauuccucuccugcgcuauuaggaaacagagacccccgaucagaucucuacgcuuucucuccgauugcugguucuuccuccuugcaccgcuugugcugcuucugcuuccccgguucugaucgcuugcgcacaugagagaucggaacgagcaagcccuccga

SEQ ID NO: 1782 - RNA, 80 nt, Oryza sativa
gcgcuucaucugacgcgaggaugaucggagccauccaucagauaggacgucucagauuugccccgcgucgggccgccgcu

SEQ ID NO: 1783 - RNA, 206 nt, Oryza sativa
cuguaucaaaucaucacgaagaggccuauauaaauccaaacauuaacacgacuugugaaacggagguaaagugaauuaaaauucucucgcuaacguuacuacaacuuaucauaauacuaacgugaacaugaccuaacauaaggacaguaacgagugcaaucaaagcaacaagaggcuuauagguucuacaugaagaacauacaaac

SEQ ID NO: 1784 - RNA, 189 nt, Oryza sativa
aggacgcgucgguggcggcggcgcggaagcugcaccuccuccuccgcucccgggaccuccgcccggcgcucuccuaccuccgcacccuccccucgccgcucacccuccuccccaaccacgcccucaacgcccuccuccgcgcgcucgccgccgccggccgcguccgcgccgccgccgcccucuuccgcc

SEQ ID NO: 1785 - RNA, 306 nt, Oryza sativa
cuagcucccgucaucugauuugucccuuuccccuuaauauuuuuucaguuuucuaguuuucuucagaagcuaccguuauuauuuuuuaaguuuucuucagaagauaccgcugguuggagcuucguuuccacugcaccucgagccuggcggagagcacaauucaggucgcggcuucgucggaugcuacuauugucacugccuccacuaucaggagccgucccugcaaaccaucggaagagcuuguggagagagugggaagaggaagauugggaaggguggaggaagaugaacuugacaggugggucc

SEQ ID NO: 1786 - RNA, 132 nt, Oryza sativa
acaccucugaucagaguauaaucuauucgaauagccgcguccucgguuauggacauugcuugauguguaucucacucauguuagcaucaaauguggauuauuauggaugggauuauguuugauggugguguu

SEQ ID NO: 1787 - RNA, 249 nt, Oryza sativa
ccuagcugagcggcggcggcggccggcggccggcgagcggugagggcgcgaggcggcgcggcgugcggcgcaggaucgagggagggcucggacugccggcggggggcaggcggacagcggcgcgacgucgucacggcgagucggcgacggcgcggggcggggcagcggccagcggcggcgccggcacagggacucugggagggagccgggcaggcgggcagccggcagccgaccagccggggagaggag

SEQ ID NO: 1788 - RNA, 98 nt, Oryza sativa
ucccuccgucccaaaauaaaucaacuucuagcuacgaaccuggauauagguuauguccagauuuguagccagaaguugauuuauugugaggcggaggg

SEQ ID NO: 1789 - RNA, 81 nt, Oryza sativa
aaaagcuauuucgugggcgucugcgugccccuccccccgugcagagaggggaagggcggcggacggugcgagucgguuucc

SEQ ID NO: 1790 - RNA, 100 nt, Oryza sativa
uaauagguuaucccccacagcuagcaugugcuagggcgacugcacgggauaauucgugccgucgcccuagcacaugcuagccgucugggauaaccuauua

SEQ ID NO: 1791 - RNA, 182 nt, Oryza sativa
auuuugagcuuuugauuacaacguuuaaccacucuucuuauuuaauuuuuuuuucaaauauaaaaaaaaguuaugcuuaaaguacuguagauaauaaaguaagucacaaauaaaauaaauaauaauuucaaaaaaauuugaauaagacgaguggucaaacguuacaaacaaaaacucaaaau

SEQ ID NO: 1792 - RNA, 104 nt, Oryza sativa
aguauacaaucaaacuuuuauauauauauauauauauauauauauauauauauauauauauauauauauauauauauauauauauaugaguuggauuuuuuugc

SEQ ID NO: 1793 - RNA, 277 nt, Oryza sativa
ccagguaaggugcugacucgguagcuagcauaucaaccucucccaaaagaguguggaacgcugguggguacggcggaguaaggaagaaguagcgguuacgcccuacugcuauggaaguagaagcuccuguggugcugacuguagcugcucgaagcugcuccuuaagcuggcugacgugcuccugacucucucucagcugcuccucgaguguauccaucaucucgcggcgaucauuguacugaucagauagcugcuggaacuggucgccguggaccug

SEQ ID NO: 1794 - RNA, 159 nt, Oryza sativa
aagauggaacugacggcuagguuucacgugcaauucagacuaacggagauuuuuauggaaaacgagauggaguagcacaguuucaauuuuuucaaauucuaguaacauaaauauagccgauauugugaauaguagugauauuuaucucaaaugauauau

SEQ ID NO: 1795 - RNA, 124 nt, Oryza sativa
gguggcuaagccgcagcaguggucggcgucguuccacggcgcggcgcggcggagcagcggucgcugacgcagccugacuugcucgccgagcauguggccgcugcacgugauggcgcgcuucgag

SEQ ID NO: 1796 - RNA, 74 nt, Oryza sativa
cgaggcacuccuggaagucggcgucgcaggacagaagcacccacucguggucgucguccagguacuugacgucg

SEQ ID NO: 1797 - RNA, 131 nt, Oryza sativa
aguuggggucgggggcgguggaggccucggagcagagacggagcgcgagggcgagcuggagcugguacgccuccuccgccugcugcgcccagcucuugcugccgccgccgccgcugcugccggccgggcga

SEQ ID NO: 1798 - RNA, 138 nt, Oryza sativa
caaaagaugguaaaggaugguauuccguucggaugggaugauaccucugaccaguaucaggugauuccuaccaguaccaggugauaccucagugguaucaucucauccgaacaggauaccguccuguagcauuucccu

SEQ ID NO: 1799 - RNA, 308 nt, Oryza sativa
caucgguugauuccaggacucugaagccgauauugacucuaaaccgaugauaacuuuggacuuaccaaauuucacuguuaacgaaugcacgcagauugauagguaaggguucggaacuucggaugcaugcauguaauagucaaauacagaugggugggucaagguugcauuuuucguucaaaaacaaaacagcaaacaaauuugacugugcgccuaauuuuguuggacauaaaaaaaaaguuucugagcccucugauuagggacggagggaaaauuaaaguugucugcaaaguuugaaacuauaccaa

SEQ ID NO: 1800 - RNA, 67 nt, Oryza sativa
cgccugccccugccacguccuggcgugccgccucgcgggccgccgccgccgcgcgcagacuaggagg

SEQ ID NO: 1801 - RNA, 71 nt, Oryza sativa
cccuacaccuacuauaggcuuguuugggagaacuuaaaagucugauaagcaacuggaugguagcagcuucu

SEQ ID NO: 1802 - RNA, 140 nt, Oryza sativa
ggauccccuucuucugccgcucguuuuccauugccgacgcgcagcacgcagcugcgcagccacaccuuugcggcugucuuaucuuguucuugaguuguguucuugguuggggaggaggaggaggagaugaagauccagug

SEQ ID NO: 1803 - RNA, 159 nt, Oryza sativa
cgggccgcccccaaacccacguggcuccccgccaggggggaucaagcccgggguggagcggaggcuacccccacccagcuagagggaggaggccacccucaaacccacguggcucuccccgaggggggucgagcccgggguguuguggcggcugccccc

SEQ ID NO: 1804 - RNA, 138 nt, Oryza sativa
acacggagugugcacgggaagcuugugugcacaggauuauguucccuaagauaaauggacauauuugaccaagaaauaacuguuaaagagacaauuuguuuucccaaugugcauacaagguuuuagcauagaaccaua

SEQ ID NO: 1805 - RNA, 120 nt, Oryza sativa
auguacacccuccgucccaaaaaaaacccaaucuuguguuugaaccuaucaggauuggguuuuuuuuuccuagauagguucaaacccaggauuggguuuuuuuggacggaggguguccag

SEQ ID NO: 1806 - RNA, 114 nt, Oryza sativa
gugcacuuugcgaauucgcaggcccuauccugugguaugaacugaguacgcgauaauuuauggugcauauuaggggcuuaccauaagauaaugccaugaauucgcaaaguguuc

SEQ ID NO: 1807 - RNA, 266 nt, Oryza sativa
agacaugggguuggagacagaggacgagucgggggaagcaggggccgacgacagcgaggagauggagcgcuggaggcgacgaucggggcugcggaucuucuucuggggacggagcaaugcugcggccgccggcgcgucuucuaaaacuggcaccggcugcugcgucucggccgcggaggaggagaucgccgcgcucacucccuuccccuuccaucuccgcccgugcccgcgcgcuccuccaccgccuccgccuccgccucugucca

SEQ ID NO: 1808 - RNA, 169 nt, Oryza sativa
auuccugggcggaaugcuugugcggucgcauuuaaggaccgauuccuucauaauuacauccgagcauauaauagugcaaccacauggguggagugggacaccccuggcugaguaauuagcuaaucaggggagccuugaugccgagagacaaguggauucgccgggguag

SEQ ID NO: 1809 - RNA, 89 nt, Oryza sativa
gagcagcgccgccgccgccgaagccaccaaauggggagcccccggggaacacgggggcggcgguggcggcgguggcggcggugggaagg

SEQ ID NO: 1810 - RNA, 120 nt, Oryza sativa
ggccuccaggucgcucgcguugcugauggacacggacgccucgucccgggacgacgucgugccgcgcgacgggucguacggcgccgcugguccggcggccgcggaguugaggagguugaa

SEQ ID NO: 1811 - RNA, 81 nt, Oryza sativa
cacugcuaccucugucccaaaauguagcuaccuagugaugcccguacuagguagcuacauuuuugaacggaggaaguaccu

SEQ ID NO: 1812 - RNA, 211 nt, Oryza sativa
auaucaaaauuguagcccucgacgugaccuacaacuuuguaguugaaaaguuuuugaauuaaaacuguuuagggucccaaaauauuguugcauguuuauaauuuugaaauuuuaauuuuaaaauuacauuuugggacaaaaaaugacuuaaaauaaaauaaaaaaucaacuacaaagauguagaucgcgucgauggcuacaaauuugauau

SEQ ID NO: 1813 - RNA, 311 nt, Oryza sativa
cuggaaucauggaaauaugcacuaagcgcuaacugacagauaacaaugaaaaguuuacuccucauccucaacaaccuugguucccaaacccuugagacccucugcagggaucucagcaacugugaccagagaguagagcuccuccuuggcguccuccucaucguuucucuugcgagagauucuaacacggacucgccuugggacacuccggauaccauugguccagauggccuuguuaagcuucacgucgaugcguauauccguugugcccauggccuucugugcaaacuuccugaucuccuugauggcau

SEQ ID NO: 1814 - RNA, 115 nt, Oryza sativa
ggguauuucuugacccacuuuaguucaacuaaaaugaacuaaguuucacuuuuagagagucuaaagugaaauuuaguucauuuaguaggacuagaaugggccaaagaauacccau

SEQ ID NO: 1815 - RNA, 167 nt, Oryza sativa
cuggaacuucuucauucguauguuggcgcguuuaugauauugacaacaaguguuuaugguggcuuacugaucgugauuauauaaauguaaguucuauauuuuacuucuuuuucugccuauuuguauuugcugcuucauguguucaacuuaugcccaggaacgacagg

SEQ ID NO: 1816 - RNA, 304 nt, Oryza sativa
uggcuccggaggcggugacggugacgguggcggaggcgccaucuuggcgagcuucgcgucgauccucuucuggaacgcgcugacccgcucgcgcacgaugcccggaaaccucuguaucucgcgcuucuugacgcacaccucgucgccagggcauucgccggcagcgggaaccucgucgagcgccuuccggaaagcggcgaugaugucuggaucgaacuccggugacccgggcgucgacugcccccgucgcuccucgccgcggacgucgcccuccucauccuugucguccaggccuuccaugagc

SEQ ID NO: 1817 - RNA, 201 nt, Oryza sativa
uacuuuguaauaauuggauguagcucugauaaguaaaugccgggauguuuauucuauuaucuaaaauaaaaugauugauguguugaacacuggucgguacacuagaauauggugauccagacgugcacguacaucgacucgcugcagcaaaaacguucccaaaagaguucacgagucaggcccacacugauagucuucgcg

SEQ ID NO: 1818 - RNA, 295 nt, Oryza sativa
ccgcggcggccgcggcgguggcgguggcggcggcgcucuaggggcgaggagaccuccgcucccgagcgauacgagggggaggagagugacgcggccagcgugguggucgagcggagccgauauauauugggccgcugguuucacgcguggccucggaugggccuagcggaugcuauccaugaauuuccgugggcuucacggcccaacagguugccuauuuuucuuuuggaauaaguucauuuugccuccuucaacucauguccgacguccugcugcuccugucgcuccacugagg

SEQ ID NO: 1819 - RNA, 201 nt, Oryza sativa
gagguuucggagaggagaggagaggggaagcgacgcgccggaguuggaggcggaggggaauucgaaauuuugggggaggaguggagaugaaaucugaaaugguuggaauugauggcgacuugacuuuuuuuuuuuuuugaacuugauggcgacuugacuugucaacgcgaguuccuucucucuuuuuuuuuucuuuucucc

SEQ ID NO: 1820 - RNA, 205 nt, Oryza sativa
aucagugccuggauggacuaguguugauagcgaugaagagacccaaggaagcccagaguaccaagaguccaaugauaguagcucaagaacugaaacagaugacggcgacgacgauggucaaggaggccaaggcacuacuaaugugcccuccuaggggucacacccaacaaucagaucaccacagccccguucaauucacuggugu

SEQ ID NO: 1821 - RNA, 309 nt, Oryza sativa
gcacaaggaugcccaaggcaugcccgucggcaugcgucgucgucgauucgggcuuggacgccaugcgcguuaacuucaagcaccuuucaaccaugagguaguucgaggaccucgcggcgaaaaucuuagggagaaaggagauggugcguucguaggagaucuucguuggcgacaaguacaagcagcaauaguccgccgccacacucgcuuuccucauggaugcaacuaggucgacuaugacgaacauccgagaaaggagagcaucgacuaugacgacauccgagaaguagccucgagcggccagaaauc

SEQ ID NO: 1822 - RNA, 67 nt, Oryza sativa
gccacgccgucgaugccagcgccggcggccgaggcggcggcggcggcgacuacggcgacggcgaacu

SEQ ID NO: 1823 - RNA, 102 nt, Oryza sativa
cugacaccaaaaguugagauggccgaguuggucuaaggcgccagauuaagguucugguccgaaagggcguggauucaaaucccacucucaacacucauuuuu

SEQ ID NO: 1824 - RNA, 304 nt, Oryza sativa
cuccaugcugcggcggucguaggugacgccgguggccaccgugacgggguccuccauuagcuccaucgagauggggcacuggaacaggggaggaggcuccauggccgucguccuggucgcccggcggccgccgcccuccuccucccaccaccgcgcucgccuccggccccgugccguuccucgucgucgacagccucucccgcaaccacgacggcgcgccgcggcggcaucggggcagacggggcagcugggccuccccaugaucccgccgccgccgccgccgccggcugccgcaccuccucuc

SEQ ID NO: 1825 - RNA, 84 nt, Oryza sativa
ccacgauugguaagcuaauuuggacuggccaaguuuggcuacugagagagccaguuuggccagccagauggcuuggccauccgu

SEQ ID NO: 1826 - RNA, 300 nt, Oryza sativa
ggagucaaguugcaucgguuuuaauaguuggguggucgagcuaucugguauuguaguucagggauacaaauaagauuugauuacucaacgggagucuaagugaacuuauucccaaccaauuucgccaguucguguggguuggaccgacgaauucuuugaugggaaguacgugguguggguucauggaauaaguucacuuuagauccuucauuuugacaccgagucuaaaauucaucauugaacuaaaauacgagaugcaaugcaaccuucaacucuaaaaaccggugcaaacuugauccu

SEQ ID NO: 1827 - RNA, 266 nt, Oryza sativa
augauggugaugcaucgguuguugccauauauguuuaugacauaaacaacagugcaaaucaacuugaaccaaggcaaaagguaacuuuuuaaacaaauauucccacugaaguugugguuguuuuauguuuuuaauauguuuucacauuaaauucauauuuaaaauauuaaguuuuucauugauaaaaauuucaggaguuccuauuagcugguaacaacaauaggguucaacaaguauauggcagcucaauugagcaacacucuagc

SEQ ID NO: 1828 - RNA, 272 nt, Oryza sativa
cacacuuuuguagcagugcccaagaccugagccaauguauugcccugaaaauuacuuugcccuauggugacgaaauuaaacaaaauuguacuaugcauacaaaacagugaggaagaaaauugcuggaugaaguguccuauuuuuuuuccaagcgaaguguuauaaccuuguccuauuuuuuuccaagcgaaguguuauaaccuuguaugaaaaagugaacccaaaucuuucaguuagcaaaugggcuuguuuggcagugcugcuuugcagcu

SEQ ID NO: 1829 - RNA, 287 nt, Oryza sativa
ccaaacgggcuccaacccgcuccgugagaugacguggcaugccacggugaugcuuacgugucaaugggauccacaugucauucacauaaaaaaauaaaauuuaaaaaaagaggauagagagaggagaaaaaugauguuuuuaauuuugaaaaaauaaaugaaaaaagagaggagaaaaaaauguucuuaauuuuuucuauauauaacugacauauggauucuacugacacauaggcgccaccaugacaugucacguuagcacacggagugaguuggagcccauuuga

SEQ ID NO: 1830 - RNA, 264 nt, Oryza sativa
guuugguuagugaccugaguaucgugccugagaaaauuguaugccuaaguggcacauguaggaguggacgcagcagaugcgcaagaggggccagagcacccccuauacguacaugaagcuaaccagcaauguuguaguggcauacaugagugccacuuaauauuuaggugaguucugaauaauauuccuucgauccaugucauucauugcuccauuucuucuauauaacguugagguuuaguauuuagauaucacugcuagaau

SEQ ID NO: 1831 - RNA, 168 nt, Oryza sativa
auccacucguugagaaguaugugcuccugcagaggaauuuccacuuucucccugcaagaauucaccguucgacccgaggucugaaucucccauggaggaaucgacaucuugcacagacuuggguuucuucgguuccucugcuggagcggcugcuucuugcgaagcgga

SEQ ID NO: 1832 - RNA, 207 nt, Oryza sativa
gcucaauucccaaacaaaacauaugaauuaaaaacgagaccgccaugaaaugauguaccucaaauucuucuaacugaacacaauagugaacgagucccuauaaauccucaucaauuagcugaugaauacgcaaguaugucgggagagagggcaagucaaaauggagcguuauuccuugauuagcguaugguuugaugggauugccug

SEQ ID NO: 1833 - RNA, 262 nt, Oryza sativa
ugauaauacuugucguuuuagacaaggguaaggucaaacuuuagaaucuuugauuaugaaucauuuuuuuagggaagauuaugaauuauuuuuaaaauauuugucuuucaaauauggugacuacauguauagauuagucuuaaaaaguacuuuaauaaaaucauauauuuguuaacacuuuuauacauauuauaauagaaaauaauaguuaaaguuguuuuuuuggagaucgugcccuuguccaaaacgacaaguauuauca

SEQ ID NO: 1834 - RNA, 90 nt, Oryza sativa
uaguuggacgugacacaucuuauuauaauaaaucuggauauaaucauguccaaauacauuguacuaagaugugucacaucaaaccaaaau

SEQ ID NO: 1835 - RNA, 307 nt, Oryza sativa
ucuacaacaguuagggcauccacaaugugcuacaaaaguaguccauagggaauaaacuauuccauuuagccauuuaguaacacugggcaacuaguccauauaaagaaaauagcaaaagauauccauaugcauauacacuaccuauaugacauaaauaauauuauauaucucuacuucucucucuucuccuaauguuacauuguauccauauacauugugagauugcuauaguuaaaguuuauuuauaugggucccaucuauauaaaccacuuuuaacauauacauugguaaugcccuuacaucauac

SEQ ID NO: 1836 - RNA, 158 nt, Oryza sativa
cccaacagccgcuggaccucgauuucacacugcucccaaacgucaccauggaggaggccaaggaggcccgucuauccgaguauccgcugcaacgagaccggugcguugguaucagcagcaauggccuuagguacgucgaggugcgcgcgcauaggcau

SEQ ID NO: 1837 - RNA, 220 nt, Oryza sativa
aggcgacgugacggcaugcggcggcacggggcgcgaagaggcgcggcagcggcgauggcguggauggggcggcgcgucgaggaggacgagcgcgcgggccagagggaggucgaggccuugagccugcggccgcgugcgugccgccaugcgcaccgcggcgccgugcgugcugcuguccucgccgccgccuccggcccuguccgcgugcgugcgcgccgcu

SEQ ID NO: 1838 - RNA, 311 nt, Oryza sativa
  misc_feature (140)..(239): n is a, c, g, or u
gcagcgaggcgagcgacgggagcggaggaggcgaggcggcagcggcgaggcagggcggcgcaggggcgggugcgugcggcggcugggugccgagcggcggcgucuucucuccccucucccacccgcgaggcuucucgucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnucgccuccucccccgccgcgcucaccuccucgcggcgacguuguccccccgccaaccgccucgccgccgcug

SEQ ID NO: 1839 - RNA, 76 nt, Oryza sativa
aucaucauaucgggcggcgagaacaucagcucgaucgagguggagucggugaucuucagccacccggcggugcugg

SEQ ID NO: 1840 - RNA, 122 nt, Oryza sativa
gacgggaucucgaccucgacauccauaucccacuagaacuugcuaccguugccacuaucuuaugguagugacauugauagcaaguucgagugggauacugaugucgaggucgaguucucggc

SEQ ID NO: 1841 - RNA, 137 nt, Oryza sativa
accaauauccuagauugcuuucaaggucauuucuuuauggaagcccauucccauaaauucaguauccaaagaugguuguuguaucuaaauagggguuccauaacgaaaugaucuuggaugcaaucuaggaguuugcu

SEQ ID NO: 1842 - RNA, 61 nt, Oryza sativa
ugggcuggacugggccagcuagggguucggccgaaccacccugguuggcuccccuggccca

SEQ ID NO: 1843 - RNA, 310 nt, Oryza sativa
aggucguguuggaguagaugggaucucauccgagugauuugaggccgacucggaugagaugaucuuagaguagaccucggccaaguucgggagaccgaacggggcagggaccuagucucucccuggcugguucggaucugagccaaggagagaaaucuugccgaagucguuggugaugaagucgaggcuaccgaaucggaacgccugcccgggaggaaagacgaagucgucgaugccggagaugaaacccaucgcacuagucgacgaaaaaacuugacgcucccucuaccuggcgcgccaacugucgaaa

SEQ ID NO: 1844 - RNA, 97 nt, Oryza sativa
cggaguggcggugcgcgaaaucggcggggcggagcgguggcaauccgcugcggcgccuccaacucccuccgccgucaucaucgcgccuccaccgagc

SEQ ID NO: 1845 - RNA, 195 nt, Oryza sativa
uuuuauccuaucaauaaagcuagccgaauggcauucccccaaaaaaaaauauaccaugaagggggagagagagggaaaaaagguuccaauauccauuucucacccaauuccucccuccacccuaucuuucaucuaggaaacaucuccauggaccacuugacagccauuauagcuaguuugggugauguaggugag

SEQ ID NO: 1846 - RNA, 236 nt, Oryza sativa
aagcauucggcgcggcgguggcgguggcggcgcgggccuuggcguccuuccacugggugagauucuccaccgagcugagcaccggauucgcgucgcgcgucuguugaggcgcgggcggcgccuccggcgaggugacgccggaagccgcuucauggccgccgccgcucuccuuagucuugcucauuggaagcaggaagagcgacucgcacgccucguccucgccgcgcccgaugccg

SEQ ID NO: 1847 - RNA, 155 nt, Oryza sativa
aggacuaaaaucagagugggcgacgaauugagggaucuaaggugaacuuauuccuuuugcagagggggcucacccaccaccuauugucgcgcacauccuauauucacauaaacccaauagugcaucucguaacguugcuucucgauugaucgugu

SEQ ID NO: 1848 - RNA, 93 nt, Oryza sativa
gccuuuaagaggaccgcacgcggaaaucgauuuucgcguacggagagguccgccugcgaaauuugauuuucacgugucgguccucuuaagcau

SEQ ID NO: 1849 - RNA, 310 nt, Oryza sativa
ggcggugggcucggcgacggcggcgguggggggcucgguggcggcggauccagugguggggaaggcagcggcggcggauccagugauggggaggguugcggcgacggauccggaggcggggaacucgguggcgggccgaccgugcgucgucgcgcuucuccgcccgcccgaccacgaugguggccaugcucgcccuccucuccaccggccucucccucucccucucccgcgcggaccucgccgccgucgucgucgccgagccgcggcugcucugcgcgaaggccgacaccaucgccgccagugcucgguu

SEQ ID NO: 1850 - RNA, 72 nt, Oryza sativa
ugcgggucacuuaacaggcccgcacgcaaaaauaacucuauuuucucgugcgggccuccuaaucuaaccgca

SEQ ID NO: 1851 - RNA, 308 nt, Oryza sativa
cccccgccgcccgccgucgucgccgucacuggauccgucguccacgccgcucgccgucaucaccgucaccgaaucggccgccccugccgccuguuguccacgccggcgcuggaucggcuacccuaccgcucgucgucgacgccgaccaccggcaccaccguucgugcgagggaggagcgcccuuggcgccggauccgcguggagcgccgccacucgaggcggccgaaccacccccgccgcagcgguggugaggagggggagggucgccucguugucaucgacggcggcggcggugaggaggggauggc

SEQ ID NO: 1852 - RNA, 58 nt, Oryza sativa
aaaaauuucgggggggggcgccagccacucuggcgcacucccuagccaccucagcauc

SEQ ID NO: 1853 - RNA, 188 nt, Oryza sativa
augcucccuuuuugcuuguaauguuugaucacuugucuuauuuaauuuuuuuuuuguaaauauaaaaaacgaaaaguugugcuuaaaauacuguagauaauaaaguaagucacaaauaaaauaaauaauaauuucaaaaaauuuugaauaagacgaguggucaaacguuacaaacaaaaacucaaaau

SEQ ID NO: 1854 - RNA, 249 nt, Oryza sativa
accuagaagauaucaggaccuuauacauguuucuguccaaacggugguacuuaucagguaucagucaauuccaaucagguaucacacgauuucuauccgguauuagguaauacuugcgagauaucaccugacaccugauagguaucaccugauaccaguuagguaucaugaucuaauacauauuucuguccaaacggugauaauuaucaaguaucagaaaccaguauaaggaccugauauauauuucua

SEQ ID NO: 1855 - RNA, 259 nt, Oryza sativa
uuagccaauguuuuuacuuuggaccggauaaaguuguuuuuguuuuauuuuagaccacccaaccuacuucuagagcaucugaacgaucucgauuaugucgauuaugucaguuuucuacuugucaaugaacuccucagcuauauaugagaucauuucuucagcauauuauaaguuuaauauagauggauaaaagaauuaaggaugguucaaagugccacaaagguaaaaguauccgauucaaagugaaaacauuguuuuu

SEQ ID NO: 1856 - RNA, 282 nt, Oryza sativa
uccuucaccuucacccccucuuccuucuuccucucucuuauuuuaucugggaucuagaugaagucacaccaccggcgauggagcuagcggcggagugaguccucgguggccgguaggaaccagaguuucuugugucgcuuguguuguggcaccaugaaugaugagaguugagaacaaagggaguguccaaccgguggguuggauaggaucacuagaucaaauggugggagagaugacagagauuagugagagggagaaggaagaaggggugaaggaaggagg

SEQ ID NO: 1857 - RNA, 91 nt, Oryza sativa
aucgauauuggauaggaucaugugauacuucacauguaucaaucauaaugaaacucauguaucacaugauccuaccuacccauguaucaug

SEQ ID NO: 1858 - RNA, 70 nt, Oryza sativa
acggaguguuuuggagcccguuuggaccuauauaacaccuaggacuagcucggaauccaaaaguacauuu

SEQ ID NO: 1859 - RNA, 64 nt, Oryza sativa
gacauaucuuaguauaauaaaucuagacagcccuuuguccagauucguuguccuaaaaaauguc

SEQ ID NO: 1860 - RNA, 234 nt, Oryza sativa
aacacauguaugaaacauuaaauguggacgaaaaaaaccacuuacauaguuugcauguaaaucgugaaacgaauccuuugauccuaauuacgccaugauuuaacaacguggugcuacaguaaacauucgcuaauaacgaauuaauuagguuuaauaaauuaucucgcaguuuacauguggaauuuguaaauucauuuuguuauuaguuuauauuuaauacuucaaauauguaaa

SEQ ID NO: 1861 - RNA, 87 nt, Oryza sativa
uacuccaccuguuccaaaauaaacaaacguaguauagggugugacacaucccguacuagguuuguuuauuuugggacagagggaggu

SEQ ID NO: 1862 - RNA, 116 nt, Oryza sativa
acucgcuccgucuaaaaaaaacucaaccuagaagagggaugugaucucuccuaggacaacgaauuuggacaaauaauaguccagauucguaagguugaguuuuuuugaauggagga

SEQ ID NO: 1863 - RNA, 64 nt, Oryza sativa
acgaaauguuuaacucgcacaaugacaacaaaaaggugucgugguguaguugguuaucacguca

SEQ ID NO: 1864 - RNA, 184 nt, Oryza sativa
uuuugauauuuugccuguacuguuugacaacucaucuuauucaaaaacuuugugcaaauauaaaaaaugaaaaguuguguuuaaagaacuuuggauaauaaaguaaaucacaaauaaaauaaauaauaauucuaaauuuuuuuaauaagacgaaugaucaaauaguguaagcaaaauguuaaaa

SEQ ID NO: 1865 - RNA, 128 nt, Oryza sativa
uacuacaucuguccuaaaauguugcuacacacauccuaggauaacgaaucuggauagaccucccauccucuguccagauucguuguuuuaagauggguagguagcaacauuuugggacggaaggagua

SEQ ID NO: 1866 - RNA, 80 nt, Oryza sativa
gcagucgacggggccggaggcugcggcggggcgguggggcugccccgccuccuccgccgccgccucgccucgccgcugcc

SEQ ID NO: 1867 - RNA, 234 nt, Oryza sativa
ucgugguuuuucguguucaaguuugaucgcccaucuuauuaaaaaaauaguuucacauaaaguaauauucauguuuuaucauauaauaacaauaaaaauacuaaucauaaaaguuuuuacaaauaagacagaugguaaauguugaacacaaccaaugcaaaacugcagucuucugggauggaaguaguauaaaacuauggcgugcggguggcaaacugaugugauuagccacuu

SEQ ID NO: 1868 - RNA, 291 nt, Oryza sativa
ugcucgccgcugcuacucgaucugaaccugcccgccucguccccgucgucuuccgauaacauuuacguuacaaauuuugaaccaaauuuuaucaucuucucuaccauuuucuagcuauugguacagcugaaagcagcagcauccccuuuggauacagagaugcacaagagaggcggcggaaacgaaaucuugaguggugaaaaagagauggaggaaaacgaaaauaaaaagaaaauuauccgugucuauggaggagaugguagagcuucuucgcaguagcagcagcaacaa

SEQ ID NO: 1869 - RNA, 158 nt, Oryza sativa
gauaguuuccgaccguuuuccgauucugacggauaguauccuuacuguauucauuuucguuuccaagaaaaaaaauccgaauuuguuuccgaauccgagaauuuucggauaguuccgaccgaauguauccgaauccgaaaaaugguccggacagaugg

SEQ ID NO: 1870 - RNA, 107 nt, Oryza sativa
auaauacaagagguuugguuuuugagugacguaauacuuucuaguaccacaaaucuagacaguacuaaaaaguaucucaucccuccaaaaucccuuauauuuugaua

SEQ ID NO: 1871 - RNA, 111 nt, Oryza sativa
cggcggaggaggaggcggcggggugggugacggucgaggagugggcgggcuccuccgccgccgcgcucucccgcaccgccguccucaccgccucccccuccuccucccucg

SEQ ID NO: 1872 - RNA, 71 nt, Oryza sativa
cgggaggcggaggcgccggaucgugugcuccgcgcuuccgcugcugccacucggcucgccuccuccucccc

SEQ ID NO: 1873 - RNA, 86 nt, Oryza sativa
auggccaaaugggccguccggccagcauggcccaagcaagaccgggcuugggccgauguuagucgggcugacccacgggcuacacc

SEQ ID NO: 1874 - RNA, 101 nt, Oryza sativa
uugacccuuuuucucuaguuuguguucagcaucuaugucaacuaugacgcugaacacaaacugacacagaugcugagcacaaacuagagaaaaagggucau

SEQ ID NO: 1875 - RNA, 275 nt, Oryza sativa
uaguuucaagucaccugaaaauacauaaaucucggucuuuuuuagaccgucaagauuucauccaaauucauguggacuuuuucucucccccuuauaucuucucuucuaucgaaaggauggaugcacacaagcacggaacuuauguuugguuuggggaccuggugggauggguuagguccauuaagggggagagaaaaaguccacaugaauuuggaugaaaucuugacgguauaaaaaagacugagauuuguguauuuucaagugacuugaaacua

SEQ ID NO: 1876 - RNA, 79 nt, Oryza sativa
gcaugugcaguacugcucacugacauuugggcccgaugggcuguggggcccacaugucaaugagcaguacuacacguga

SEQ ID NO: 1877 - RNA, 279 nt, Oryza sativa
caaagacccgcgcuccucgucaaugguugucagagcgggacagccuuugcgcguugcuacugcugacaagguuucacgcauggcaaaugaagagaagggaggaagggaagauggcaguggucgagcuguugccacugagacauugucuucgagccguugccgccgacaugcugccaucgcccgaggucgaucugaagccaccucucucgauccgcgcaaccaaugucauuucaccgccagcaacuuggcagccaggggagggggaugugaggggaccga

SEQ ID NO: 1878 - RNA, 139 nt, Oryza sativa
uggucucgcaugccugaagcgcgagagcggccucggcaccgcgcuuucguagcacgagagccacuguggagugggucccauggugauuuucugguuggugcuuaguccggcacgguuucgcacauuagcaaugcaacaa

SEQ ID NO: 1879 - RNA, 261 nt, Oryza sativa
ccacuugugcucggggaaguucgaucgaucccucaccauggcgucggagaaggaggcggcgcucgccgccgugcccaacgacaaccccaccaugugagcaccucucucucuccugccgcaaaacccgcucugauuuguaggcaguguaguacucgugugugcuucuugaucucauggauuggcagauugcggcaucacuaguuuaucauggccuaguacgcugggagaucauugauucgaacaccucccugucucuuuaaa

SEQ ID NO: 1880 - RNA, 65 nt, Oryza sativa
ucucucacucucccucuguguguguguguguggaccuauggacgcacggcggaggagugcagcaa

SEQ ID NO: 1881 - RNA, 90 nt, Oryza sativa
uagacgaaucuuuuagcaugggcagggccacccucguuuacgcaccuguacugaggcauuggccacugccuucucaagcagaugucguuc

SEQ ID NO: 1882 - RNA, 311 nt, Oryza sativa
cgaggcgguacucgugcaugauccaguuggucuuggugcccuugggcgggcggcccuuguagaagacgagcgccuucuugacgccgacgcucucguuggucgccgcgccgccgcugcuguggaugggcuugucggugccgguggccuuccaguagccggagcccgcggcgcgguucggccggaucccguucggguacuugcggucccucgggcugaagaaguaccacucccuguccccguaauucuccuuggcugaugcaaaucaaaacacaagucgaucaccaacgaaauuaauugcaaaucagugaucg

SEQ ID NO: 1883 - RNA, 239 nt, Oryza sativa
augugagccacuggagaaaauguaucaaaguaaucuucucccugucuuuguguguaccccuuugcgaccaaccuggcuuugaacuugucaauaguuccaucagguuucaguuucuugcagccuauggcccuauagccuauggcccuauagccuugaggcaagugugugauuucccaagugccauuagagaggauagaguccaucucacuuugcacugcuuccuuccaguaugcagcuuc

SEQ ID NO: 1884 - RNA, 274 nt, Oryza sativa
ggcggaggagcggcggcgggcgagcgcggcggugggcaaagcagcggagggcgagcuaggcgaagcagaagacaguggaugggacgaggagcucccccgugcucggccgccaccacugccgugcccccgcggguggccgacgaugcuaggagaggcaccaccggcggaagaaggggaagaggcagaggaagagauuauuucuuggucgccggccgccucccccucccucccaaacucgcuggccgccgcgcucgcucgccgccgcuccgccgcc

SEQ ID NO: 1885 - RNA, 161 nt, Oryza sativa
cgccuucuccuccuccugguccuccuccgccgccgggcgcuucgccgccgcgcuccuccucguauccaccaucuccgcccccccucgauccgcgaggggaagagagagagaggaagacgagauaagggcggcggaagagagaagagagagagagagacgcg

SEQ ID NO: 1886 - RNA, 274 nt, Oryza sativa
uuuaucugcugacauggcuucuccuugccagaacagcucgcaagugauuuggauugaaaacuaccaccaacaucaauagcaguugguuuugaugaaguugauggcagcuugacuuucucuuuuucuaaaccggggccuuuugagaaagaaaagcugcgucgacuggucuggucauugcuacagcuaguuagucuucugcgcuucgucacuggggauaaguacuugcgcuuuucaauuuuaguuuucuggggaaagaagcuugucgcaccaauug

SEQ ID NO: 1887 - RNA, 263 nt, Oryza sativa
ccuuccauuugggcggcaaacugacguggcacacggcgccgugugcguauuuugugccuagucccuugcagcccucuguaaggguagcaaggggcuaaaugcaauuuuugccgugccaaaaagcaauuggcuaguucuuuuugcaucuaagccccuugcugcccucgcgaauuuugcacggaguccccuugccgcccucgcaguccuccaaaacgacugucaugcguccaugugccacgucagcuugcugcccaaauggaggu

SEQ ID NO: 1888 - RNA, 68 nt, Oryza sativa
uucguuguacuaugaaguauauguccuauucgauacuagguugcuauauuacuaaguagaaaaucauc

SEQ ID NO: 1889 - RNA, 68 nt, Oryza sativa
acgaccaccuccgccgccgccgcugcugccgucucacguggccggcgugcgcuacggccaccaacaac

SEQ ID NO: 1890 - RNA, 295 nt, Oryza sativa
gcucccuucgcggcucuccuucuucuucuucaaucuucgcccuccuccuccuccucguacgcgcccacgcgguucucuuucugcccccucgaucgauuugagguuugcccuuguuugcugugauguuuugcgcuguuaauugggugauuaauuugggggggucggguuggguuggguggaucgauggcugauggguucuuucuuggucgauugguuuucagcagggaacggaagggggagguuuuuggaggaggccauggugccgucggagaggggggacgucgccaccgccauc

SEQ ID NO: 1891 - RNA, 106 nt, Oryza sativa
auauguaaacccuucguuccauaaaaaaaacgaaucuagaacugaaugugauacauccuacuacuaaagacauugauuuuuuuaugguacgaagggaguaguguac

SEQ ID NO: 1892 - RNA, 110 nt, Oryza sativa
uguguucuaggguauuuugguauuuuccugucucuuguacaauauauauuucugugcuaaauauauuuuguacaagagaugggaaaggaccauaauaccccuaaagcaca

SEQ ID NO: 1893 - RNA, 114 nt, Oryza sativa
aguguguucuaggguauuuugguauuuuccugucucuuguacaauauauauuucugugcuaaauauauuuuguacaagagaugggaaaggaccauaauaccccuaaagcacacu

SEQ ID NO: 1894 - RNA, 82 nt, Oryza sativa
aacccucagauuggggauuuccugccggaggaagcuuuuuggaggagcugccuuugggaggaacucuuccaguucugagggu

SEQ ID NO: 1895 - RNA, 65 nt, Oryza sativa
cuggacuagugauaugauaugcuauuuuaauacgauaaaucuagacacccguauuacauauaaga

SEQ ID NO: 1896 - RNA, 93 nt, Oryza sativa
caccccacaaugaaccagaaccaccguguccccgucaugaggugaaaaccucgggaucgcgggacacgggcgguucugguuuacccucacugg

SEQ ID NO: 1897 - RNA, 187 nt, Oryza sativa
uagccauaauuuuccgcgcgcaauuuuaaucgucuauuuauuuaaauuuuuuuuaaaaaaaauuaaaaacauaaguuacgaguaaaguauuauucauguuuuaucaucuuauaacaacaaaaauacuaauuauaauuuuuuuaaauaaaacagaugauuaaaguuggacgcgaaaauuuaugauugc

SEQ ID NO: 1898 - RNA, 311 nt, Oryza sativa
guguuggaaacucgugaaaaucauaccuaaaaguuucguaaauuacauuagagauagguguaaauauaaaauacauucucaccaaaucucaaguucaaacucaacuuaauuuaggaguaaaaaaaacaaauuuuaggugaauaguaacaaggcacuauucacccgaaauuugucuuuuuuauuucucuuaaacgaaguugaguuuggaguugacauucagugagaauguauuucauaucuaaaccuaucucuaguauuuuuuuuaugaauuuaugaaacuuuuagguacuauuuucacgaguuucuaacac

SEQ ID NO: 1899 - RNA, 285 nt, Oryza sativa
cuccggcacgugcuggaucaggaugcagauccccgccgagauccccagccgcuuguccaggcuuccgcuguacagcugcaagaaccagaggccaagcaggggaacggcucucagcacagccgcgaccgagcggaggaugaagaagaagcuaggggacuacuagguagcgaaccuuguuggugaaggggacgagaucgccgagggcguucuccgucugcuuggcgcugaggcggagguaggcggggcucucgcggucgcgcucguugaucucguacacgaacaucu

SEQ ID NO: 1900 - RNA, 122 nt, Oryza sativa
ccgauacggaugauaccuauccgugacgggcguuaguacucugcccgauacggaugauauggaauaaucucuaucgggcauaguacuaaagcccgucacagaugacuuauuaaaauauuuuu

SEQ ID NO: 1901 - RNA, 237 nt, Oryza sativa
acuaauaaaauaaauuauuauacaacagcuauauauuuuguacucacaaauauaaagacuuaucuggaaaaauggaaaaauagucauuagugacgggcccuacggcaaagcccgauugagauagauuaaucucuaucggccguaaacuaaggcccgucaccgacgacucauuuuccaucuuucauuuguugugagugcaaaauauauagcugcuguguaauaauucauuuuauuagu

SEQ ID NO: 1902 - RNA, 61 nt, Oryza sativa
cuaccggagcuugcacagcagcaacgguggccacguguugccugccuguguugugcuucau

SEQ ID NO: 1903 - RNA, 85 nt, Oryza sativa
uuacaugccuuaucuugugguaugaacugaguacgcgauaauuuaugguguguauugggggcuuaccauaagauaaugucguaaa

SEQ ID NO: 1904 - RNA, 86 nt, Oryza sativa
agacuaguagugcauguacuccuccuccaguacuacuagugcaugcaguaguauauggcagucaguaguauaguacguaguacuac

SEQ ID NO: 1905 - RNA, 114 nt, Oryza sativa
gccagggugguguggccaaauaacgcugccacgccagcuagaccggcauggcuaaauacguugucacgccaaccagaccggcaugguaguauuguuuugccacgccaguccggc

SEQ ID NO: 1906 - RNA, 180 nt, Oryza sativa
gcaucaucgcaacgcagcugcagaucggaccaaaucgaccccuacgguagaaaccccaccccgccgacauagaccaagaaaaagaggagcgaaauccaagaaguggaaccgcaaccgcaccuuuggggucgaccuucuucuugaagauguucauggcugcugcugcugcugcugcuagau

SEQ ID NO: 1907 - RNA, 70 nt, Oryza sativa
ccugcgucuccgcuugccugccaccgcuccgcccgccgcgggagagagggagggaggagggagaaggaac

SEQ ID NO: 1908 - RNA, 311 nt, Oryza sativa
guuuuuuuugggugguuucucguguuggcuggaucuguguugaauuuguuuggguuuuuuuguugguuugcucggaucugugauccugggggguuuugcucgugcuguucugaucucguuggugccagaucuguguggagggguugauuuggugguuuuuuuggguggaucugauggggauuuguguguuuuuguuuugguuguuugcagaucaucaacgacagggagacggggaggucacguggguuuggcuucgucaccuucuccuccgagcagucgaugcgcgacgccaucgagggcaugaacggcaa

SEQ ID NO: 1909 - RNA, 101 nt, Oryza sativa
gagcucgacggccgcaacaucaccgucaaugaggcccagucccgccgcuccggcggcggaggcgggggcuacggcggcggcgguggcggcuacggcggcgg

SEQ ID NO: 1910 - RNA, 76 nt, Oryza sativa
aauccaauccuagauuagaaccuggacacauguguguccagguucauguguccagguucaaacuuaggauuggguu

SEQ ID NO: 1911 - RNA, 116 nt, Oryza sativa
uaauaucauguccagauucauuaugcuaugcuaugucucauucuugccuagccuaaauuguuuuuuuagacacauagaguauguagcagaaguugugacaaucugacuugugaagu

SEQ ID NO: 1912 - RNA, 63 nt, Oryza sativa
ccgccgccaccaggccggucagaccgcgcauauagcgccggucagaccgccuggcccccagcc

SEQ ID NO: 1913 - RNA, 70 nt, Oryza sativa
uuaccacguuucaggugauacuugcgagguaucaggugauaccuaucagguaucaugugauucuuaccac

SEQ ID NO: 1914 - RNA, 100 nt, Oryza sativa
uuuugugcaguaacaaguauaugguuaguaugugaggcuuuaacccagcaauacuagucacuuggccguaauaagaaccuauauauuuguaguaaccgga

SEQ ID NO: 1915 - RNA, 310 nt, Oryza sativa
acgcaggcgcuccccaucuccggcuuccucccucucccucuugcucuccuccacacggcgcccucacgcgcgccaccugucucucucucucucucucucucucucucucuccucgccgcucgcucgcucgcucgcucgcguggggaggagucgcuagggcuucgaccuccgcauuccgaucucgcgccgcgucgcugccgaucggcgggguuugguguuugguguuuuggggauggugucgggugggcgcgugggggguggagaaggggaggcgggggaggcggcggagguggcgguggcgaugguggau

SEQ ID NO: 1916 - RNA, 91 nt, Oryza sativa
ggcgggggaggcggcggagguggcgguggcgaugguggauaaugaggaggagauggcgcaggcgcaggcgccacccgcggcggcgguggcg

SEQ ID NO: 1917 - RNA, 204 nt, Oryza sativa
cucuccgucgccaugguuuuccgcguccaacuuuaaccguuugucuuauuugaaaaauuuugaaaaaaauuaaaaauauaagucacaaguaaaguauuauuuauguuuuaucaucucauagcaauaaaaauacuaauuauaaacaaauuuuaaauaagacggacgauuaaaauuaggcgcggaaacuuaugguugcccuuaaaa

SEQ ID NO: 1918 - RNA, 135 nt, Oryza sativa
ugcaauuuacacauuuacucccucuaucccagaaaaaaacaauuccuagcuuugcauuuggauaaacaauuguucagauuuaaaguuaggaauuguuuuuuuucuaggacagagggaguagauguguaauuugug

SEQ ID NO: 1919 - RNA, 268 nt, Oryza sativa
ggcggcgcggcgccggugccguggcgcggcgucgucguggcgcggcgucgugucgugaugagguaggcgucagcgucugaaacucagcggccggcggcaaccgagagggagagagagagaucgagaucggagagagagaucgagggaggcggcggcggcucucaccccagagaugcggcgguggcggaggaggcggaggcggcggcgacgacgacgagcgcgagacgacggcgagauacggcggcggcgucggcgcggggaugcccua

SEQ ID NO: 1920 - RNA, 179 nt, Oryza sativa
aacauagauuuucguguucaacguuugacuguucguguaauauaauuuuuuuauaauuaguauuuuuauuguuguuagaugauaaaacauaauuaauacuuuaugcguaacuuaucuuuuuaauuuuguucauaauuuuuucagauaacgguuaaacguugaacacggaaacucagggu

SEQ ID NO: 1921 - RNA, 74 nt, Oryza sativa
gggaggccgguggccacgucgaggaugccguugccguugggguagccguuguacgacguggucaucagcgccga

SEQ ID NO: 1922 - RNA, 71 nt, Oryza sativa
uuucaaauuuuccgucacaucaaauguuugaacacaugcaugaaacauuaaauguggacgaaaaaaccuaa

SEQ ID NO: 1923 - RNA, 175 nt, Oryza sativa
gagauagguauaggcaugaaauacauucauaccaaaucucaaguccaaacucgacuucauuugagagaaaaaaaaacacuauucaccucaaauuugucuuuuuuguuucucucaaaugaaguugaguuuggacuugagauuugguaugaauguauuucaugucuauaccuaucuc

SEQ ID NO: 1924 - RNA, 170 nt, Oryza sativa
aauauuuuaacacuuggcacuuaacugcauauauuuugguauugaaguuucauaaaacuacacuaucagagaaugcauccacgccaucucgccgauggauucauucguuaguuuugugaaacuucaguacuaaaacauauguaguuaagugccaggugucaaagggugug

SEQ ID NO: 1925 - RNA, 112 nt, Oryza sativa
caucuucgauagccaaggaugauuugccuguagccccauugucaucagcucucuccgucgagagcgacaaccgggcucuacuggcaagucuccucggcuacccgaguaccuc

SEQ ID NO: 1926 - RNA, 107 nt, Oryza sativa
aucuucgauagccaaggaugauuugccuguagccccauugucaucagcucucuccgucgagagcgacaaccgggcucuacuggcaagucuccucggcuacccgagua

SEQ ID NO: 1927 - RNA, 178 nt, Oryza sativa
ucaugaguuuucguguccaacuuugaucguccaucuuauuugaaaauuuuuuauaauuaauauuuuuuaugagaugauaaaaacaugaauauuacuuuucucgugacuuauguuuuuaauuuuuuuaaaaaaaauuuaaauaagacggacgaucaaauuugggcgcggaaaaccaugg

SEQ ID NO: 1928 - RNA, 144 nt, Oryza sativa
aacccauauaucagucacauauagaaaaaaucaagaacauauuuuucuccucuauuuuuuuauuuuuuuaaaaaaaauaaaaaaaaucccuuucucuucucuuuauaaauuuuauuuuuuuuucuauauggcuggcauauggau

SEQ ID NO: 1929 - RNA, 212 nt, Oryza sativa
uuagugauaaaacuaucgguuugcuauaacauuaacgauauuuuuuaguuugcuacaacaacagugugugaaauuaucacaaaacugaaacuuuuacguuauuugcuacaguugucaccuauauauacuguaguagcauauaauguaaacauuguaguauugugauaaguucuuacguuauuauuguagcaaaucgauaguuuuguaacuaa

SEQ ID NO: 1930 - RNA, 84 nt, Oryza sativa
acuagaugggacacuucauaguauaaugaauauggacaggaagcauguccauauucguuguacuauaaagugucacauccggua

SEQ ID NO: 1931 - RNA, 291 nt, Oryza sativa
cccacagcgguaggagcucggcgacuggaucggcggccgccgccgccuugcgccgccuucucucccccuccgccuccgccuccgccuccuccccgucgcgauccuccgucgcuguccccgucccuguccgcgagcgccgccgcuccguccuucccauccagaucgcgccacccuauccgccggcgcgucguacgccuccaccaacugucgguccuccgcggcuccgccucccggucaagauccggcaccgcgccgccguccuccguugccuccgccuccuguccgagaucc

SEQ ID NO: 1932 - RNA, 272 nt, Oryza sativa
auggaaugcaugcuuugguugcugcauggucaaauggaauacaugccuugcuaugcucauuguaauugcaauaauguuccaaaucccagacaacaagcauguugaaucauugcuaauuguugcauccauuaugcuaagcccaaggcggcggcaggaauuaaaccacggauggcggcgacgcguaccgaccgccgcggcgggcggugcuacuaguuguugggcuucugugggcucugaugaccauguuucgucggcuaaauuaacuaguuuca

SEQ ID NO: 1933 - RNA, 309 nt, Oryza sativa
cggcaguacaucaaauguugaucacauauuaaccuuaugaaagcauauacucuagguggauuugccaugggggcagugggggcucgagcccccacuaccggcgcugagacuaugggggccccccuuaauauuuucugccauacauauauacauacaugggaaggggguauggagcuuuguccaguuuguuuagccuccccugguauuucuucuuggauccacgauauacucacaggauuaaaaugaauuauaaccuaguccuuaugcuugcauaagauuaaaaugugaucaacuuuugauuuacuuuua

SEQ ID NO: 1934 - RNA, 302 nt, Oryza sativa
cuccuacgauuuugcuaguuagcuaguugcacuugaaaaagguaggcaugcaacagaacuaguuuugguauccuucgauugaacuaaucugccgacgacguacgcagauauauacggauggaguacgguggccaaugcaacgacaaggacaugcuguacaguaguguucaaguuguuaugauccugaucgauccaaguuauaauaugguacgguuuuggagagcuuauaaucugguacgguuuuggagagcuuaaaaaauuugagaaguagcuggcuaugguugguaagggcaaguuuuaua

SEQ ID NO: 1935 - RNA, 250 nt, Oryza sativa
ucuauaaacguacacauggacaucauaccucuauaagcacaauaaaaaacaauaccaguaaaucuuuucaaccuauuaaacacauauuuuauuauuuaucuccgugcggcgguggaauauauucacaugccuacaaguacauaagauagagaagcgaaaggguagcucauguauucuuggucaauugggcaugaugaguucaaggucgcgcgcagaggggagauugugugucccugcguauaccaugcau

SEQ ID NO: 1936 - RNA, 81 nt, Oryza sativa
ugugugucgaugugcgacuacggauccggcaccggcgacgggagcggguggcggaucuauagccggcgacagcggcgggcc

SEQ ID NO: 1937 - RNA, 65 nt, Oryza sativa
gcgucuccuuccagucgaugcgcgcgccggcgaaggccgccgcgucggaguuggcccgagggaag

SEQ ID NO: 1938 - RNA, 57 nt, Oryza sativa
gugaucgccguggagucggagcugcugggucgcugggcggcuugcucggcaacgaug

SEQ ID NO: 1939 - RNA, 142 nt, Oryza sativa
cuccuccauccuauaauauagcaacuuauuacgggaugugauauuuuacagugcaacgaaucuggacaggaggauguauagauucauuauauuauaaaauguuacagcaguuacuagguugcuauauuaugggacagagaga

SEQ ID NO: 1940 - RNA, 77 nt, Oryza sativa
ugaagagugauuuggccauucuauuggagaugcucuaagagguuauaguucuaugggcauggcuaaaguuggauuau

SEQ ID NO: 1941 - RNA, 166 nt, Oryza sativa
agcaacaaggaccgcauagcgcaguggauuagcgcgucugacuucggaucagaaggucguggguucgacucccacuguggucguuaauuuguugacucuuuuuauuuucaccguauaugucuuauuucugccacgcguuauuuauugcguuuaugcuucaguauug

SEQ ID NO: 1942 - RNA, 66 nt, Oryza sativa
ucggaucagaaggucguggguucgacucccacuguggucguuaauuuguugacucuuuuuauuuuc

SEQ ID NO: 1943 - RNA, 311 nt, Oryza sativa
aaagacacucuaaaaaacugguaauuugcuaaaggacacuuucaacucauuuggagagagaaauuauucaaaaagacaagaguaucccuaggaucaaaaaucuuuuugcgcugagacuagaacaaagauggaauauaauauaugcuacugaaguacucagggagaugacaaauuuagauuugcauaauuucuaaauuuuuacucuaagccauguuugaagcauguggucauaggggcauucucgucuuuauuaagaauuuaucaauccaauucagccaaaaguauccuccagcaaauuaccagucuuuuag

SEQ ID NO: 1944 - RNA, 62 nt, Oryza sativa
cgcuaccugugacgggccuaaaccaucaccucugacggauucggccccucgucagagauuag

SEQ ID NO: 1945 - RNA, 254 nt, Oryza sativa
  misc_feature (115)..(115): n is a, c, g, or u
gaagucggcggcaagcacggggcugugggacgugcuggcguucagcgggccggcgccggagccgaucaacaggcggcuggcgauggugggguucgucuaggcgcucgccgugaanggcgucgcgcggcggugagcuccuggaggagccagcagcgggggcgggcucgcguaguucgcccgaccgccgccguucguccgucccgcccgucgcgccgcguuacgcgucccccgccgccgcugccucuguccgacuc

SEQ ID NO: 1946 - RNA, 236 nt, Oryza sativa
aaggcuaaucuuguccaacccagcccugauccaccccguugccaacccugccaguugcuaggaucugagugcauuagagaggccugcuaccgagcuucagcucucuauugucaucuagagaaaguaaucguuggagcucuagguggacagagcuagaucaugagcuugaggucaaggguugagcugacgauggccaugguggaggucaggaauuggagguggagaagagauuggag

SEQ ID NO: 1947 - RNA, 150 nt, Oryza sativa
agagaaaaccucacgaaccccuuccagugucuaaucgaucgggcgauuaauuuuaggguuugagguuagagagaaaucagaucgucacccagccucccuccuucucuuucuuuauauaagcgacacugguggggcucggggguuaucuca

SEQ ID NO: 1948 - RNA, 77 nt, Oryza sativa
cauucgcauggcagcggugcauuuuugcaauggugauagacccaccuugccaaaugcaucucgccuuagacgaaaau

SEQ ID NO: 1949 - RNA, 221 nt, Oryza sativa
uaaggcggagucggagcugcugcaucgggucagccgaugaguugggcaacgauaacacucaacacuuuugcucuuguuucuugaagguucuacacguuuuaagguagucuuaggugaaauucuugccuggucuuacaggaucggcgacagucuugggugaaauccuugucuggucuuacaggaucggugacaucgauguaugcgggugcuguuuccuccuu

SEQ ID NO: 1950 - RNA, 293 nt, Oryza sativa
uagcuacuacccccguuccauaauaauugcauuucuaccauucaaauuugucaaaaaaauauuguauuucuaauaauaugggaagcaacaaauggaauguguacccaaaccuuccuuuuaauuaaguuuacauauggaaugugugucccucaaccuugcuuuuaaucaaguauacauauggaauaugcauguaguuauuaaauagggauauuguuguaaauuguguuuguuaauguuaaucuaucucuaauuuucuagaaaugcaauuauuaugggacagaggcaguaguguu

SEQ ID NO: 1951 - RNA, 229 nt, Oryza sativa
ccucccgagauccgccgcucagugcugccgccgucuucugggcagagcuccagaagcucgcccccuaccucucgcgccaauggcguuggcagcguccgcggccgcgcagcuccggugcugugccuccaccgucgacgacggugucguugacgcagccgucuuccgccacgccgcuuggcaccgccggcaucuucggccgcaccgcuggaugcugccggaucuguugcuc

SEQ ID NO: 1952 - RNA, 160 nt, Oryza sativa
aagcucagcaucggcacgccaccaagccuggcaugacagugucacgccaccucaccccgcugccauaucgaugccugcuugacccugucaacacgguagaccgucacaggacaacuuaguuagcccacgccaguucugguggcguggcgaagagguuugu

SEQ ID NO: 1953 - RNA, 181 nt, Oryza sativa
gucacaaguuuccgcgccuaacuuugaucguccgucuuauuugaauuuuuuuauaauuagcauuuuuguuguuauuagaugauaaaaccaugaauaauacuuuacucgugacuuauauuuuuaauuuuuuuaauuuuuuuuaaauaagacgaaugaucaaaguuaggcgcgaaaaaccauu

SEQ ID NO: 1954 - RNA, 234 nt, Oryza sativa
cgcgcccccguccaccgccuccgccuccgccaccacgcgacgcgcguggggugcucgacggugucggugucgacccgcccugccacgaccacgaccacgaccaccacgcgcucccagccgccgccgccacagccgccucaggccgccgagccgcuacaacggaggugggggccgacggagcggcggaagggcgcggacauccucguggaggcgcuggggcggugcggcguccgc

SEQ ID NO: 1955 - RNA, 310 nt, Oryza sativa
auuuguacuuucgcaugcaggugggaguggagcgccaucuauccucaaaucgagcgagaaccguagagguaauuaacacgggcacacaacaacaagcuugacuuggccgauacaacguuuaccucgagcuugagggaggugauuugaugguggacgccggugucguuccucccauggcguuguuccuccuccccaguccgcucccgucgccaauccccacccccacccccacgcugcucuaguuuguuuucuuauccucccaccaacacuaccuccucuccgcuagcucucucucguccucucaggcugu

SEQ ID NO: 1956 - RNA, 119 nt, Oryza sativa
guagacugcgagacgaauuuacuaagccuaauuaaucuaucauuagcaaauauuuacuguagcacaacauuaucaaaucauggaguaauuaggcuuaacagauucaucucguaaauuaa

SEQ ID NO: 1957 - RNA, 73 nt, Oryza sativa
augugauacauucuaguacuacgaaucuggucagggagucuauccagauucauaguuuuagaacgugucauau

SEQ ID NO: 1958 - RNA, 278 nt, Oryza sativa
aaauacucacuccuuccuaaauugaucaucauacaauggaaucuaaaauuucucaaauugaucaacauauaaccguauggacacggauuuuaucauaauacaauuaauucaguaugggagaaugugugcaugcuaggguguaauugacaugauguuuuaaucaacacaugcauuauggaagaacgugugcauagugucuugauugaugcaauuuaaauuaucauuagucuugguacauaaacauauaugaugaucaauuugggauggagggaguauug

SEQ ID NO: 1959 - RNA, 127 nt, Oryza sativa
ccaccagaucuggcaucccuugcuagauccagccccuucucguccgaauccggccucaucggugcgagaggccggcucccgaguugguggcggugaucaaguaacggggugcguguagguaacaggg

SEQ ID NO: 1960 - RNA, 311 nt, Oryza sativa
ccgcucucucuccccuuuaucccucuccuccucaauccccauccucucucucucuucucccuccauucaccuccaucucucucucuagaaucgagcuaagcagggaggaggcggaaaauucccauaagcuggugacggugguggccuccaagggacggagcugcacaguggcggggcugcaucagcgacgaagcucgacgauggcucgccucagagaggguacuagaggcaucgguagcgaugguggacucgaagcucgugcaaagacggcggcuguggugguggagcuggagcucgcaugaaggcggaga

SEQ ID NO: 1961 - RNA, 248 nt, Oryza sativa
uaaacauauguuuuuacuuuggaccggauaaauuugccauuguugcgauuuggacuaccacgaaugauuuuuuuucucaugcaaucaacgaccuuaaacacaucagcucuaguauacggccaaucuccucuauauaugguucauauguuugccgaaaggaaaguuaaacaugacgagaaaaguugucaugguaguccaaaccgcaacaaugguaaauuuacccuguccaaauuaaaaagauagguuua

SEQ ID NO: 1962 - RNA, 286 nt, Oryza sativa
caucgccgugaugccgaggcgucuucaagccgacgcucucgucuacaccgccaggcgauggagauugcuguccaugcgaucccgccggagguugccggcaagccaucgucguuacaucggucuucgcccaugccguccaauggaguggagucgccgucaaccgggaggccaugacauccacuuugucaucgacgcucuaaaucucgccaaccucgucgagccgccagugacaccgucugccgaaggccaucucgucggaagacgccuucgugccgucaucgccgca

SEQ ID NO: 1963 - RNA, 229 nt, Oryza sativa
gugggcggcgacggcggcggggguggggaugggaauggcgggggauggggaggggagcgagucgagggcggcgggggagaccgggacgggacggggagcgccgcguuggcggcggcggcaggacggaggggccgcccaacucaacuccacgggccgccgcuuuucucucucggccaucgcuccucucccucggccaccguuccucugccucgugggccucgugggcggu

SEQ ID NO: 1964 - RNA, 97 nt, Oryza sativa
gggguugaagaggauuggagggguuugaggggaaauaauuccacaccacaauagguguggauuaaauccccuccaaucucucccucucggagauuaa

SEQ ID NO: 1965 - RNA, 305 nt, Oryza sativa
ucauccgauguccaaagugcagaugacgcagcuugggugcugauguggcaauccacgguggugagaauuuugcauuuagcccccucaugcuacaguaugccuucaagucuacucccaccacucccaaaucuuuuggugcauggcuuaaacuaugaauuugcuggaugcugagaaaugcauauuuguugauuuggggugguaggagucgauuucggggcauacuauagugaagaggcguaagugcaaaauucucgucacuguggacaagccugaguugcauccucugcacuuugggccucgaguga

SEQ ID NO: 1966 - RNA, 105 nt, Oryza sativa
ucgacgaggggcuggaggugauguggggcgacggccgggggagcgucucgccggacgggcaggugauggcgcugucgcucgaccacaccuccggcuccgggugga

SEQ ID NO: 1967 - RNA, 309 nt, Oryza sativa
ggcggaagagcggcggcgggcgagcgcggcggugggcaaagcagcggaaggcgagcuaggcgaagcggaagacaguggaugggacgaggagcucccccgugcucggccgccaccaccgcugugcccccgcgggugcccgacgaugcuaggagaggcaucaccggcgggagaaggggaagaggcagaggaagagauuguuuauuggucgccggccgccucccccucccucccaaacucgcuggccuccgcuccgccaccgcgcucgcgcuccgcuacacuguccgcggccugcucgcgcuccacugcucg

SEQ ID NO: 1968 - RNA, 278 nt, Oryza sativa
uuuuuaauauuuacagaaauauuauaccagcgaaaauauuuacagaaauagacccuaccgcucaaguggagggcagcaaggugacguagcacacggcgccgugugcgcauuuugugcugagauccguaauggggugaaaugcaauuuucgccgcaugcaaaauuugcaugaccgcucaacggccuccagcgccuggucacacacaucacccugccgcccuccagugucuauuuuuguaaauauuuucgccaguauuauauuccuguaaauauuaaaaa

SEQ ID NO: 1969 - RNA, 73 nt, Oryza sativa
ccucggccgcuccgcuugcgccgccgccgccgccaccggagcgacggcgagggagggaguggggagaagcagg

SEQ ID NO: 1970 - RNA, 76 nt, Oryza sativa
aaaaaaauccaugucauuguccacguggcgugcuacguaggcaagaccacaguuaaacgagacauuggaccgggau

SEQ ID NO: 1971 - RNA, 98 nt, Oryza sativa
ggauuuuggagggaugugacacaucguaggacaacgaaucuagacaagcuccugacuagauucguuguccuaggaugugucauaucccucuaaaaucc

SEQ ID NO: 1972 - RNA, 268 nt, Oryza sativa
uccucccccccgcgucgccucccaccacgcgacgcccuccuccuucuucuacccccuccacccccucuucuccccguagccaaauccgccgcgucucagcucaacccagcagcgcagcagcucaagccuucucgcguugcagcgccgcgccgaggagguguuuguugauuuguggagaugguggggggagaggucaugugcgaggcggcggcgccgagguacaggggggugaggaagcggccgugggggagguucgcggcggagaucc

SEQ ID NO: 1973 - RNA, 103 nt, Oryza sativa
aaucauauuuuuuuuaggcggaccacuuaagagauccgccugcgaaauaacgguauuuucacaggcagaucucuuaagugguccgccuagaaaaauugauuuu

SEQ ID NO: 1974 - RNA, 192 nt, Oryza sativa
auccuugauaagugcgaguuucauagaaugucaucauacaaaugacuuuacucuagaaauguuauugucguuaggguuccguuagcaguuuuugguuaagugagcgggauagauggaacccuaacaaugacauuuuguaggacaaaguugauuguacgaugauauuucguggaacucguacuuguuaauaac

SEQ ID NO: 1975 - RNA, 70 nt, Oryza sativa
uguguuauuuuggccuugauucacaugcaccggacaaauuugugcacugaaucaagcguuuuauaaguuc

SEQ ID NO: 1976 - RNA, 59 nt, Oryza sativa
gagucauuucacauuuaguggacgaugguuuguccauucuacaauaugcugaugauaca

SEQ ID NO: 1977 - RNA, 96 nt, Oryza sativa
gaccagcucgauaugggaucgaugugagcaucugagucgucguucguuuugauggauggcucagcucagaucgguuccaaaucaaucaaaaccaca

SEQ ID NO: 1978 - RNA, 86 nt, Oryza sativa
uauauaucuuuucaguugcaggauuaaacugauuggcacgcucguaucucaucaagucuuggaccugcacuggagcuaagcagauc

SEQ ID NO: 1979 - RNA, 117 nt, Oryza sativa
ccgauacggaugauaccuauccgugacgggcauuagaacuaagcccgauagagauggaauaaucucuaucgggcauaguacuaaagcccgucacagaugacuuauuaaaauauuuug

SEQ ID NO: 1980 - RNA, 68 nt, Oryza sativa
guucacagagaaaacuaggugguucucuacgcuuugcugcgggaauuacuaagaaauucucaauauuu

SEQ ID NO: 1981 - RNA, 156 nt, Oryza sativa
ucccacugaguuggcuccguguacuccggcuucauaaacuucgggagguguguugaagaugagauacgauucccugaaccccucccaggggucccuuuuauaccguggaucaucuugccccccaagaaaagcuugaggauaucggaccugguacag

SEQ ID NO: 1982 - RNA, 170 nt, Oryza sativa
ugauaagugauuacucccuccguccuagaauauagcaaucuaggaucggaugggacgcaucauaguaauacgaaucuggacagggggcuguccagauucauaguacuagaauacaucccauccggugcuagguuguuauauucugagacggagggaguagcaauaaauau

SEQ ID NO: 1983 - RNA, 160 nt, Oryza sativa; identical to SEQ ID NO: 1952

SEQ ID NO: 1984 - RNA, 180 nt, Oryza sativa
cucccgcuccgccgccgccgguugccgcggccaccucgccaagccauggcgaccacgccgaccaccaccaccaccacccccuccgccgccgcaucgcgcgcuuccuucuccacccucgcccucuugugaucucccuaucccugucccgcuccgccgccgccggcugccgcggccaccucg

SEQ ID NO: 1985 - RNA, 263 nt, Oryza sativa
ugucccgcuccgccgccgccggcugccgcggccaccucgccggcgcggccucaaagugcaagggcgcaggagcggaggagaacaagaaagggcaggagcaggaggagcaggaguaguaggaggcguccgcgacggugguggacggcgcggaggaggccgggaaggaagaggggggaggaggaggaggggagaagagccccgaggcgguggcagcggugcugaaggaggcgaaggccgcggccgccgguggcggguggugggcc

SEQ ID NO: 1986 - RNA, 77 nt, Oryza sativa
uguuugggggagcuucugacagcugcaguuucucuuguucuaggagaagcugcagcugucagaagcucccccaaaca

SEQ ID NO: 1987 - RNA, 111 nt, Oryza sativa
gucggagagggccucgagcuccuugguagcggcugcggccccaugaggaggcuuuguauggaguggagcagaaggcacuguugcuagagagggcuccgagcucgccggcag

SEQ ID NO: 1988 - RNA, 306 nt, Oryza sativa
aaaacuuauuucgcaaaugaaccgcggccaaaacuuauuuaaaaaaugaacacugaccucugcgccgaugcugaaugucgugccaccguggaugggaggccgacucggcgugccaacgugacaaagcucagcgccaccugacucggcgcugagauggcuaaggucagcgccgaguuguuuggcgcuguacuggcuaacuuagucaagcaguuagguauggcuugguguagugccagagcucagugccaaauauguuggugcugaagucggcacuguccgugccagguuauuuggcguugagcugug

SEQ ID NO: 1989 - RNA, 156 nt, Oryza sativa
ugauuuuuuuuuuaaauaugcuugaucguucgucuuauucaaaaacuuaaguaguaguaguauauuuaacaauaaaucaaaugauaagaaaagaauuaauaauuacuuaauuuuuuuaaauaagacuaacggucauacuguuuaaaaaaguuaaug

SEQ ID NO: 1990 - RNA, 63 nt, Oryza sativa
ccgcugccaccaggccggucagaccgcgcauauagcgccggucagaccgccuggccccccagu

SEQ ID NO: 1991 - RNA, 176 nt, Oryza sativa
gguuuugugguuggaggaugauuuuguaacccgaugacaagaugagggaccuuugauguacuuucuccuucucuuccucucuuaacaagaacucaagcguuuuuuuauuggaaaaaguacaccaaggucccucaacuugucaucaaguuauaaaaucaucccucaaccauaaaauu

SEQ ID NO: 1992 - RNA, 310 nt, Oryza sativa
cguauccgucuugguacguauucguuccguauuuaugcccgauauuauccgugcuucuauucguauccgauaauauccgugcccgacccgauuccgauuauaaaauauggguuaggauaugggaaggaugagauccgaccgaacccgacccgauuucaccccuaccuguuggugguuuucuuuucaagucugcuuccaaaucuuagggccuguuuaguucgcgaaaauaaaauuuucaggugucacaucggauauuugaucggauguuggaagugguuuucggauacgaauaaaaacuaauuucauuacc

SEQ ID NO: 1993 - RNA, 102 nt, Oryza sativa
cguucaaaauaagcuaaccuaggauaugaugggacauuaccuaucuagauucguuguacuagguaaugcccuaucguauccuagguugguuuauuuugggac

SEQ ID NO: 1994 - RNA, 240 nt, Oryza sativa
gugaucgccauggagucggagcugcugggucguugggcggcaagcucggcaacgaugacacgugccuugugaugucaacguugugugccgcuucuucaauaucucgacaucgauguucgcuguuagauuccgccuuuguuuucguugauaguuuggcuagaguuguguggaguuccgugugcuguguggauguaccggucgcgguugaaggacuuggcgagucucuacucguugagaggu

SEQ ID NO: 1995 - RNA, 216 nt, Oryza sativa
ucucauuuuaagugcaaccaugaguuuccaugcccaaauuugaucguccgucuuauuugauuuuuuuuauaauuaguauuuuuauuguuauaagaugauaaaacaugaaucguacuuuacgcgugacuuauguuuuuaauuuuuuucaaaaaauuuugaaauaagacugacaaucaaaguugggcacggaaaaucauggcugcacuuaaaauagga

SEQ ID NO: 1996 - RNA, 80 nt, Oryza sativa
uuuuauaauauauguaaauuacuuuuagauuacauuaaauuacuucuuagucauaaaaguaauuuaccuauauauagaag

SEQ ID NO: 1997 - RNA, 88 nt, Oryza sativa
ugaugagauguuguagaucugaacaaguguaaacaauauggaugcuuuguuguuugauuuuauucauucgaucuaugauuuaggcuuu

SEQ ID NO: 1998 - RNA, 101 nt, Oryza sativa
ugguuaaguggguggugcgcucguaguguagaagguugccacauagaaaauuuuuguuacguguuccaucucagcgagauugucacauacucacaucagca

SEQ ID NO: 1999 - RNA, 95 nt, Oryza sativa; identical to SEQ ID NO: 1759

SEQ ID NO: 2000 - RNA, 310 nt, Oryza sativa
ggcgggcuggggcagcggcggcggcggcgauggcggcguccagggcgggcuggggaagcugccgcggcggcgacggcggugucuaggguggguuggggaagcggcgacgacggcggcguccagggcgggcggggaagcggcggcgaugacggcgcccucuaggucgaacgggggcagcggcggcggcgcccucuaggacgggcgguggaagugacggcggcgaugacgcccuccaggacagguaggggaccggcggcggcgggagccgccucgccucgccuccgccgcgcucgccuccuccgcggcaccu

SEQ ID NO: 2001 - RNA, 119 nt, Oryza sativa
ggaggccauguaguggagagcagaggaggaccaguuugagaaaaagaaaagaaaaaaaaagauguagugcgcguacccauaaaaaggucuaauuuuucaguucccguauaauguccuac

SEQ ID NO: 2002 - RNA, 224 nt, Oryza sativa
cuccgucccauucuaagugcaaucaugauuuuccgcgucuaacuuugaucguucaucuuauuugaauuuuuuuuaaaaaaauuaaaaacauaagucacgaacaaaguacuauuuauguuuuaucaucucauaacaauaaaaauauuaauuauaucuuuuuuaaauaagacgaacaaauaaaguugggcacgaaaacucauagaugcauuuaaaaugggacagau

SEQ ID NO: 2003 - RNA, 70 nt, Oryza sativa
uaauuauuugucacuuauagucuaugacacauggauucuuaugugucuauaacauauggauccaaugaaa

SEQ ID NO: 2004 - RNA, 310 nt, Oryza sativa
ggcaacggcggcgggguguggcggaggagacgagcggcggcggggugcggcggaggaggcgagagcggcggcggggugcggcggaggaggcgagcgcggcggcgucgcgggccacgcggagccgccucgccucgacgagugccgccgcgaccauggcgagacaggccgucgcuggugaggcgccucgcgagcggcaccaccagguggucucgcccugccucgccuccuccgcccccgccguucgccucgccgccgcgcucgccucuccacccccucgccuccuccgccgccgccucgccucgccgcgcuc

SEQ ID NO: 2005 - RNA, 103 nt, Oryza sativa
gaauuuagaacuggaugugacacaucauaguacuauaaaaucuggacauacauuuguccagauucguuguauuagaauaugucacauccaguacuauguuuca

SEQ ID NO: 2006 - RNA, 84 nt, Oryza sativa
auuaucgugaguucccuucaagcacuucacaugacacuauuucaaugucuauuaugugaaguguuugggggaacucuugguauc

SEQ ID NO: 2007 - RNA, 85 nt, Oryza sativa
ccgguccaugcgugcaugcaugacagauucgacagaaagcuaaucaaacuguuuugugugugugugugcgcgcgcgcgcaguugg

SEQ ID NO: 2008 - RNA, 97 nt, Oryza sativa
caaacuguuuugugugugugugugcgcgcgcgcgcaguuggcuuccggcucgccaccggcagccgcgcgcggucguacgccaugcgcgcccgcgugc

SEQ ID NO: 2009 - RNA, 142 nt, Oryza sativa
ggauauccagugaacaguguuauucggauaucuacagaagccaugagacauaccuuauuuuuuuauaaaucuaugaccuuuaauauagcuuuuuuagauuuuaacaguaguucauaucuuaacacuaguucacacuauuaau

SEQ ID NO: 2010 - RNA, 142 nt, Oryza sativa
ugaucuuuagccuuguucaguuaaucuccgagagggagggauuggaggggauuuaagggaaauaauucuacaccacaauagccuccaaaucccccucaauccccuuaugagagggauuaaccgaacaaggccucuuagugga

SEQ ID NO: 2011 - RNA, 225 nt, Oryza sativa
cgucaauucucccucugguuccaaauguuggucguuuuagagcugugcacaggaacuaagaaguguuacaauuaucuuguugcccugcaauuauugcagaucaguagugauacuucauuuauucaugagaaucgucgcauucaauuaucaagggugucugggaaaaaugggguucaauugccccugaaacaaccuacauuuggaaccagagggacugucguuuuu

SEQ ID NO: 2012 - RNA, 107 nt, Oryza sativa
agcaaaagguuucagucagauugcugguguuguuuauaaugauguguucucucguaaagaauaguucaauucgcacauucucuaguauuguuuguaugcaugaucuu

SEQ ID NO: 2013 - RNA, 150 nt, Oryza sativa
aaacccuagguuuucguguuuaacguuugaccguccgucuuauuuaaaaaaacuuacaaaaaaaauuaaaaagacaagucacauauaaaguauuaauuauauuuuaucaucuaccaacaauuaaacguuggauacggaaacccaggguuu

SEQ ID NO: 2014 - RNA, 57 nt, Oryza sativa
cucuaaccuuuugaaccgggacuaaagaacaucuuuagucuugguuuuuauugcaac

SEQ ID NO: 2015 - RNA, 161 nt, Oryza sativa
cgagggcugggacagggccaagggacgggcaauucguaacuguccggggacagggacgaggacgggguaccaugauccggggacauccucgucggguuaugguaccccguuccggggagacagguacgaaucgcccucccccggcccuguccuagcccucg

SEQ ID NO: 2016 - RNA, 76 nt, Oryza sativa
uuaggcccggucuuguggcaagaacugaguaguucguuaacucgcuacgcgguucuugucacaagaccgagucugu

SEQ ID NO: 2017 - RNA, 130 nt, Oryza sativa
gcccaccauggugaccguagaaacuaacauagaaaaagagguagauaucucaagugacuuuguucauuuacguuggaauagacaaguaacuaccuuuucuauuuuaguuucuauggucacuaugguggca

SEQ ID NO: 2018 - RNA, 180 nt, Oryza sativa
aauaucccaggcuaccgaugaaucaggguauucaaaagggcugaguaugguaaauuccaucccacaugacauuauaaaacaaugcaauuuuaagagaaaagcagggauuuugcaaguacgcucaauaugaucaaugauauccauaugacuugccuugcucuugagcugacggaaccucag

SEQ ID NO: 2019 - RNA, 83 nt, Oryza sativa
ccgaggugggggcccggugggcgaggcccgugagcgccgcuuguugcguagcuccgccaggugugcggcugcccuugcacggc

SEQ ID NO: 2020 - RNA, 212 nt, Oryza sativa
gcggggugcguccggcggcgaggugcaguggcgcggcggccaugcggaccgugaacgucuccgcgccguagcgcucgccuggaccacgaacuucuccgcgcgcuagcgggggcacuugcgcgccuccacgacaacguccgccgccgugcucgcacggcacaccgucugcacggucgccgcgccacuacaccucgccgccggacgcaccuugc

SEQ ID NO: 2021 - RNA, 266 nt, Oryza sativa
agcggcgguggcucgcggugacaccuugcggggugcguccggcggcgaggugcaguggcgcggcggccaugcggaccgugaacgucuccgcgccguagcgcucgccuggaccacgaacuucuccgcgcgcuagcgggggcacuugcgcgccuccacgacaacguccgccgccgugcucgcacggcacaccgucugcacggucgccgcgccacuacaccucgccgccggacgcaccuugcauggugucgccacgagccgcugccacu

SEQ ID NO: 2022 - RNA, 121 nt, Oryza sativa
uaauuaaguauuacucccuccguccuagaauauagcaaccuaggacuagauggcuuccaucuagucuagccaucuaguccuagauugcuauauucugggacggagggaguacuaguuaaaa

SEQ ID NO: 2023 - RNA, 131 nt, Oryza sativa
gggaggccgcuacgacgacgaugcgacugccacagggccaugggcagcgguuuuggccacgggaggggcgcaagcucuggaucgagcugccuccagccuugaggugucgauaacgauggcgaugaggggua

SEQ ID NO: 2024 - RNA, 275 nt, Oryza sativa
uugggaggaggaggcgaggcuggugguggaggacguccgccgcgaccccgccgcggcgaccuccggcguggugauccggcgaagguugcagcugaugauguacaacgacauguuccgcaucauguucgaccgccguuucgacagcguggacgacccgcucuucaacaagcucaaggccuucaacgcggagcgcagccgccucucgcagagcuucgaguacaacuacggugacuucauccccguccuccgccccuuccuccgccgcuaccucgcac

SEQ ID NO: 2025 - RNA, 246 nt, Oryza sativa
ugauacuuccuccauuucaaaauauaaggcauaacuauuuuguuuucauacguuucauaauagaagacaugcaugcaauuaauuaacuagcauauuuucuucacuaaauuacaguuuuuuaaaucaucaucccucaaaaucucuaauuauagaauuagaugcuugcauuaagaugauaauaauuauuuuauauuuuuuagguuaagaguaguuguaccuuuauauuuugaaaucgagggaauaaua

SEQ ID NO: 2026 - RNA, 222 nt, Oryza sativa
gggggucgcggugggcaggagugggagaguuguugcgacgguggugggggccgcggcucccgcuagcaucgucacucccggagggaguaggggugugcgccaccacuucuuccucuaggaccucgaccaugaucguugaggauggagggaaacuugugguggaaggaaacgauuucucuuucaaacgcgcgaauucccccuaccuggcgcgccagcugucga

SEQ ID NO: 2027 - RNA, 202 nt, Oryza sativa
auaaguguagccaugaguuuucaugucuaacuuuuaucuuccgucuuauuugaauuuuuuaugauuaauauuuuuauguuauuagauuauaaaacauuucuaguacauuaagcgugacuuauguuuuuuuaguuuuuuuuaaaaaaaauuuaaauaagauggacgauuaaaguuggacacagaaacucguggcugcacuuau

SEQ ID NO: 2028 - RNA, 302 nt, Oryza sativa
ccccuaaggcauauguguugcuaguuaaucagcauggaauucaaaucagguauuaucacaacuuuuaagaauugcauauaauuuuaguugcccguuucaaugguuuaguuuauacacuuaaaauaaguauuucgguucuacaguugaacuggauaaacguuuuggucgaccacugaguaggcggaacgagagcucgagcgauucauuuacuagucaguuuuuuuuuaccaugguugucuauuguuuagcugcaaauaguuagguuagauguugcugcauaacuacgccguguccugugggug

SEQ ID NO: 2029 - RNA, 100 nt, Oryza sativa
gucuucccgauuuacgccacgaugccgaucucaaccgguccgccaauauccgguuuacggguaccacccaucgacaguagugaguguagguuaauugguu

SEQ ID NO: 2030 - RNA, 73 nt, Oryza sativa
gcauuggggucgcggcgguggcgguggcggcuuccucgccucggcugcuccguuuuuccgucgucacgacauc

SEQ ID NO: 2031 - RNA, 219 nt, Oryza sativa
uaagugcugauuaggaugcgauguaaacaugcaugugauauauauauguucaauaaaagguaaaauaaggcaugauuguugucaaagaaagacauaaaaaaccugaguaaugaugcaaggguggaaacaaaaagaagguuaauguaagaaccgaguuuauaaauauagcauaucucaugcccaucucauaugugcauaucacguccuaaucuacaucca

SEQ ID NO: 2032 - RNA, 68 nt, Oryza sativa
ugacugccauuacgccgccggucggaccgccgcgaugccgccggucugaccgccgcugagaugccggu

SEQ ID NO: 2033 - RNA, 121 nt, Oryza sativa
aaaccuauaagcugacagugcuguguuggcugcacauuuauugacagauagcagagcaggcugaguucuucuccuuuggaacaaacgaccuaacacagaugacauuugguuacaguaggga

SEQ ID NO: 2034 - RNA, 79 nt, Oryza sativa
gauaugugguccggucagaccgggcagugauugccagucagaccggcuuguauugcgcggucagaccggcgcagcccgu

SEQ ID NO: 2035 - RNA, 110 nt, Oryza sativa
augcuacuaccuccgucccaaaauauaaccacuuuuagcuacgaaucuggacacgguugucuagauucauagcuaaaaaugcuuacauuuugagacggagggaguauaua

SEQ ID NO: 2036 - RNA, 228 nt, Oryza sativa
gacggcgacggcgauggcgauggcgaugaugacacgguggcgguguugugcuuuuucguugcaggcgcuccuggaccagcaggagaacagggcggcguucggggcgcggggcaacgucgacgccgucgacgagaagggagauaggacugcugccgccggcggcggcggcggcggcggcgccaccacuaccggcggagucggcggcgacgggcgugcgccgucgucggc

SEQ ID NO: 2037 - RNA, 212 nt, Oryza sativa
caugcccugguucucgcuuugccuuuuugccuucuucuuuggcuccauaccgguguauauaucugguucauuucuucuccccgggcuagcuucuugcuagcugcacggugugcaacgucuucugguagcaaugaagaccucgagcuucgagagcgcuaguagcagcggcggcagcggcgguggcgguggcggcgguggcggcgagggcuccg

SEQ ID NO: 2038 - RNA, 231 nt, Oryza sativa
cuugucuucuugaggucaggacaggagggagggaacuguggaaggaagaacugaagacuagcuguugcugaucuguauaucugucuguacauugcauccauggauucucuuucagcaacauguuaauuuuuagaagagaagcauuucguuuuugucgucaucauuggcaaccauguuacucuucauguucaucugcuccuuccguuuugucguugcucuugauaguacucu

SEQ ID NO: 2039 - RNA, 254 nt, Oryza sativa
acugguacuaccucugucccaaaauaauuguaauucuaauuuguuuagcauauauuaagguuugagaagaaagacuaugaugucccuuguuaaaugguguauagguaagagugugaggguaguugaggguaaaauaaggagaaauuuaaaugagaagugauuaaugaaaccauuaguauucuauugugauaacuauuuugggacaaauucaaauccuaaaaauacaauuauuaugggacagagguaguacaugu

SEQ ID NO: 2040 - RNA, 109 nt, Oryza sativa
caucaccaccuccuccuccacgucgccgccggugcgcgucgccgucgucgucgacgacgacgacgacgacgacggcgugccggcggcggaggaggaggaggaguggcgg

SEQ ID NO: 2041 - RNA, 208 nt, Oryza sativa
uuuccuucccucucuuucuuccacaucaucaaauuuacuugcauggcaacgaagauagcccauuguuagacaccauuguacaugcacuaaguagcuuauuguaugcgucaaguuuugacaacccuaauauaucggagaagucuugcaacgaaaaaaaauuugcagggauaauguacacgaucaugcggcagauaaggaauuacggaag

SEQ ID NO: 2042 - RNA, 310 nt, Oryza sativa
uauagaagccugguuucgcugauguggcauccuagucagaaaaaaaauaaaauaaauauguggggcccacauguaaguagagaaaauggugugggccccacauuucuuuuuuuucuuuuucucuccucuucucucaugauugucucgagugggcgcggcagcagaggggagagagaggcggccggcgguggaguggcggcagcgggagagggagagagagguggucggugcaagaggaggagaggaggcagucggugcgacggcgagcucggcggcggagaggaggagcgcacggugggagggaggagag

SEQ ID NO: 2043 - RNA, 96 nt, Oryza sativa
aaaaaacuuaaucuaguaauuggauaggacauaaucuggauauccagauucguuguauuagauuauguccuauccaaguacuagguugaguuuuuu

SEQ ID NO: 2044 - RNA, 147 nt, Oryza sativa
cugcacuccuugcgccagcggcacugguaugguuuccuuuccucuuaaaaguuuauggccugcucacacagggcuuuuuagauugaucagcaauaguguguauuuauaugcuuucagcauacuaugugcugcucgcauaauggugcu

SEQ ID NO: 2045 - RNA, 161 nt, Oryza sativa
gauugcacuguuugaucauucaucuuauucaaaaaaaauuuggaauuauuauuuauuuuauuugugacuuacuuuauuauccaaaguacuuuaaacacaacuuuuuguuuuuuuauuagcacaaaauuuuuuaauaagauaaguggucaaacaaugcaaau

SEQ ID NO: 2046 - RNA, 94 nt, Oryza sativa
uucgaauuuuaguucgguuaguguucccaaccagaacuaaagauguuuuaucuuuagucccgguugggaacaccaaccggaacuaaagugguga

SEQ ID NO: 2047 - RNA, 65 nt, Oryza sativa
uauucuggcugaugaaauggguuuggggaaaacaauucagaccauagcuuugaucgccuaucuau

SEQ ID NO: 2048 - RNA, 136 nt, Oryza sativa
acuaccuccgucccaaaauguugcuaacuaggaugggauuugacccauccuagacaacgaaucugaauaaaaccucuguccagauucguugucugguuuaggguuuagguagcaacauuuugggacagaggaagua

SEQ ID NO: 2049 - RNA, 194 nt, Oryza sativa
uagauuaauauguaauauuucgcuccacaaacauguaaguuaaaauucaauuuuguauaaauuguaauaaauauaacaauuuagacauuaacuagcauauguauauucauguuaaauuuguuauuuuuuuacucauaaaaaucaaauuuaaacuuauauguuuauggugggugauauauuacauuguuuuguuu

SEQ ID NO: 2050 - RNA, 119 nt, Oryza sativa
ggagaugcgauggaaaguugggagauugggggaaguugugugugaacuaaacguggauuggggcccuguuuaguucacaucaaucuuccuccaaauucccaacuuuucaucacaucaca

SEQ ID NO: 2051 - RNA, 122 nt, Oryza sativa
uggagaugcgauggaaaguugggagauugggggaaguugugugugaacuaaacguggauuggggcccuguuuaguucacaucaaucuuccuccaaauucccaacuuuucaucacaucacaau

SEQ ID NO: 2052 - RNA, 119 nt, Oryza sativa
guaaacuacgagacgaaucuauuacgccuaauuaauccaucacuaacaaauguuuauuguaucaccauauuaucaaaucauggcguaauuagccucaaaagauucgucucacaauuuac

SEQ ID NO: 2053 - RNA, 84 nt, Oryza sativa
gguauguacgcguuggcccgucugccgaaagagaccuauauuuugcaaagaggauuccacgagaagccaaugccgcaauggagc

SEQ ID NO: 2054 - RNA, 74 nt, Oryza sativa
aagccaagcaugaaauuugcauuuccccggugcccaggcuuuccaaaucaaggaguugaaguuugugcucggcg

SEQ ID NO: 2055 - RNA, 109 nt, Oryza sativa
aggaguguaaguggcuaaccugcgaacucacuuguagauuagaauaagcggguucaauuauuuauuuuggucuauaaauaagcuucacggguuagccgcuuaugcaccc

SEQ ID NO: 2056 - RNA, 174 nt, Oryza sativa
uucgaccgcccccguucuuucacuuggcgcaguuggagcaggcgguagcgccgccgccggggcuucagccuccguggaacggauugugacagcugcggcgagggucuucgguagcccucugcgucagccgguuguuucgccgcuagucaaggcgaaggggaagggugcgaccgu

SEQ ID NO: 2057 - RNA, 164 nt, Oryza sativa
uuggugcccucggagacggcgugcuuggcgagcucgccggggaggacgaggcggacggaggucuggaucucgcgggaggugauggugggcuucuuguuguagcgggcgagcuuggcggccucggcggcgagcuucucgaagaugucguugaugaaggaguucau

SEQ ID NO: 2058 - RNA, 159 nt, Oryza sativa
ggucgguggaguucgacgagcuggcggcggcgaucgcgccggugcucaccacgcagacgcaccugguggaccaggcgcagcugcucgagguguuccgggcguucgaccgcgacggcaacggcuucaucuccgccgccgagcucgcccgcuccauggcgc

SEQ ID NO: 2059 - RNA, 117 nt, Oryza sativa
cgugaaaauauuggaacaagggcgaugcagacuucuaugaaauuggcgccguaaaauuagcgauguuuuucaaugacucacccaaucuugucggccucuucuuccagaucuuguugu

SEQ ID NO: 2060 - RNA, 86 nt, Oryza sativa
cuaguaugguggguagggggagcucagggaugagaugauugaugaugauggcaggucagggcucucccuacauacgguguauaaau

SEQ ID NO: 2061 - RNA, 305 nt, Oryza sativa
aagagagcgauaucacgcuuggucucgcuauuuggaagcacgagaucgacggugagccgcgccagcgucaggcgucgcucucgcgggccccacaacgcaugguauugcgcaaugcuugcggugucucgcuuuuuggcacagcgauagcgacugugggccacgccgcuucucacaacaauggucucguggauacaaagcgugauaccgcgcgugcucucgcuguuucaaagagcgagaccgcuuuguugcggggcccaccaccucggucuggguuugcgucagaugaccggcgguaucgcaucgcg

SEQ ID NO: 2062 - RNA, 116 nt, Oryza sativa
accauucaccugaaaauaguuacuauucaccuaaaaaauauuuauuuuuacucucgaauaaagcuaaguuugaacauaagauucggugagaauguaauuuuuuucaugauuuuuca

SEQ ID NO: 2063 - RNA, 314 nt, Oryza sativa
ccgccuccccccgcugcuacgcgucccccaccucugagcugugccauagcuguccuccucuccacuccacucaccucuccaccucccaagaacucccaaaucccaccccgcauugccauuuccagcuguuguucuugauuccuuguucuucggcgaucauuucggcuucuuuuuuguggugguaugagaguuucgcgaugaggaaggaggugguguuaguggccaugguggugguggugguggugagcugggucguugcugccggcggcgaggcggcggcggcggcggcggcgguggugguggacccggcgugg

SEQ ID NO: 2064 - RNA, 111 nt, Oryza sativa
uaccgguacuucacgguacuaaaucguuucugaucguuggaucuugcuaggcaggauaagcauuguuagauccaacgauugaaaacaauuugguaccgugagguaccggua

SEQ ID NO: 2065 - RNA, 112 nt, Oryza sativa
ccaaucaggauugcaggauaugaaugaggcgagauguuaugggcuuguggcagagaugcagaguaaugauuagaaccaaaccucgucaauucaagguucuguuaggaggagc

SEQ ID NO: 2066 - RNA, 310 nt, Oryza sativa
cuuauauagauggaauaugaauguguggucauguauuuuagauuacguucaaaaaaacuuauauaaaugaaauaugaauaugacaaagcugaagaaguuaucgaaacuucucuuccugccccgagugcuacagaguauguauaaugaucugaguugauauacuacuuauuuuaauuuuuuuuaauaaugcucuguuguuuuugcuauuugguaccaugcaaaggauaugugucuauauucaauauucaaaugacguauuuucauuuuuauauaguaaaauaugggcauauggaucuuguauuauuuauuu

SEQ ID NO: 2067 - RNA, 275 nt, Oryza sativa
cguugguuugcuccggucaaaccaccauugacauuggcccaagcauccacaacaauuucacaacuacacaaaugagucuaagauuugcuagaacaaauuugcacaaaauuugugcuucacuucaaaucgaucuauuucaaccuaggguuauugguaguugguucaaaucuugugcaaauuuguucuagcaaagcuuagacuucuuuguguacuugugaaauuguuauggaugcuugggccaaugucaguggcgguuugaccagagcaaauaggcg

SEQ ID NO: 2068 - RNA, 213 nt, Oryza sativa
cauuggcccaagcauccacaacaauuucacaacuacacaaaugagucuaagauuugcuagaacaaauuugcacaaaauuugugcuucacuucaaaucgaucuauuucaaccuaggguuauugguaguugguucaaaucuugugcaaauuuguucuagcaaagcuuagacuucuuuguguacuugugaaauuguuauggaugcuugggccaaug

SEQ ID NO: 2069 - RNA, 63 nt, Oryza sativa
cgccgcggccuagagcgccgcauugccgccaggggccgccgugccgucgccugggagccgcgc

SEQ ID NO: 2070 - RNA, 90 nt, Oryza sativa
guagaacuggugugacacauucuaguacaacaaaucugaacauaugcaugccuagauuuguuuuacuaggauguaucacauccaguccua

SEQ ID NO: 2071 - RNA, 115 nt, Oryza sativa
cauauuauaagacuuccuagcauuguccacauucauagagauguuaaugaaucuaguaacauauuuagauucaucucucuaugauaugggcaaugcuaagaagucuuauaauacg

SEQ ID NO: 2072 - RNA, 64 nt, Oryza sativa
gccuggccgguucggccgaaccaugguguucgggcgaaccccuggugggcccaaccggcccaac

SEQ ID NO: 2073 - RNA, 90 nt, Oryza sativa
agcuccaucuucgcaggcggaccacauaagggaccgccugcgauuauucuagguggucuaauuaugugguccgccugcgaagauggaacu

SEQ ID NO: 2074 - RNA, 304 nt, Oryza sativa
ccaugucguaccguagcagcgauagcguggagaaauugaguggcuucucauuguucuuuugucauguauucucacuauucuuuugucauguguaggaugcuuuauucauuuugauugggcacuaauuuaguuugcuauccuuaaugaaaccacucauauaguuuaucuauuucucuuaauaaaggaaaguugaauagaggauuuugagugaucgacaguuaagugccauuguccuguugaaacaacgauuugggauuacugaagaugacuuccuccuugcuugcgugcuugguucgcguauaga

SEQ ID NO: 2075 - RNA, 121 nt, Oryza sativa
uaauuaaguauuacucccuccguccuagaauauagcaaccuaggacuagauggcuuccaucuagucuagccaucuaguccuauauugcuauauucugggacggagggaguacuaguuaaaa

SEQ ID NO: 2076 - RNA, 106 nt, Oryza sativa
aaccuaauacugaaugugacacauuauauuauaacgaaucuggacauacaucugucuagauuaguacaaucguuguacuagaauacgucacauccaguucuagauu

SEQ ID NO: 2077 - RNA, 195 nt, Oryza sativa
gcgucgccgcucggccuagacgaggaggaggggauggggaggacggcggcgccaccgcgaccaggaaagaugaacgacgcugaggcagccgcccccgccgcccucagccgccgccuccgcgucaccacccgacgccgccgcagcuccgcgccgaggccuccgcccucagccgccgucuaggccgagcggcaacgu

SEQ ID NO: 2078 - RNA, 211 nt, Oryza sativa
ucuucuucguucuccccccuccgccgccgccgccggcgccgcugcugcucgccgccgucuccgcagcuggcgccgccaccgugcaggcgucgucgcugggcuccaucggaggaggagcuagcggcagguauaauaaagcggaggaggaggagagcgagcagcggagagggaugggcaagagagagagagaggggaaugggguuugguuugc

SEQ ID NO: 2079 - RNA, 248 nt, Oryza sativa
ccaucaaauagugcgaguuacaugaaaugucaucgcauaagcgacuuugucccagaaauauuaucauacaagcaaauuuguccuagaaaugcuaucgccguuagggucccguccaucccacgccauuaaauguacuuuucauuauauagcacuuacuggagggaugacccuauuagcgaugguacuucuaaaacaauguuacuuuuaugcgaugacauuucauguaacuugcacuuaucgauguauuu

SEQ ID NO: 2080 - RNA, 122 nt, Oryza sativa
cuaaaauaaaccaaccuagauugggaugggacauaaccuaguacaacgaaucuggauagagacaugucuagauuuguuguacuagauuauauuccaucccaaccuagguuaguuuauuuugg

SEQ ID NO: 2081 - RNA, 68 nt, Oryza sativa
gcgccgacgucgucgucgcguccccggcauggcguggucggccugguacuuggcgauggcggccaggc

SEQ ID NO: 2082 - RNA, 60 nt, Oryza sativa
cgaucgaucaacagccauauauauauauauauauauauauauauauauggaguauuugau

SEQ ID NO: 2083 - RNA, 92 nt, Oryza sativa
uccaccgccauccaagcugccggaggugaccagugcgcuauggcgaauuauuugccaucgauguuuacuucggcaacuugggccuggcuaac

SEQ ID NO: 2084 - RNA, 255 nt, Oryza sativa
agucucccuguccugucagcaucgaucgccagcagccauauugugauccacagugauaucaguauuagcucuagucauaugaaaaacaaaaauauaucgaucacugugucuuuugaucaugcaugauucauaggaaaucaaccaucucaugcucuaggacgaauuaaugcaauaugugcucacauguguguuuuugguugauguguacacucauguaauuuagcagcgcgauucuuuuugcaggaaauuucggca

SEQ ID NO: 2085 - RNA, 257 nt, Oryza sativa
aauggguuagugcgguguggacugaggugagaaauggauuggauugguuuggauucugaaaggagauuugcggguuggguugguuugaacuauuugagcuaacugcugugguguggauugggaauggggcgggucuuaggccauuagcaggcuuacauaugacaaucaacuccuacguuucuucuauuucucuauguuuuuaaaauccugcauuccaaggauaucuuucucauccuauuccuauugcauagcaugug

SEQ ID NO: 2086 - RNA, 188 nt, Oryza sativa
agaagguugauggagcugccgccaucgaugagaacucgcgcuaccuugauauuccgaauaguggguucgaccacgaucggauaucguccuaggauaacagcagccuuggggugguccucaucugagaacucaaucuucuguucggaccacuuuaucuugggugcagcccccugccaugucgaacaaac

SEQ ID NO: 2087 - RNA, 79 nt, Oryza sativa
uccggcagcguagaguaccguggaguagaccugaaggaauucuucugggucgguacucccgucguacuucucuauugcu

SEQ ID NO: 2088 - RNA, 142 nt, Oryza sativa
ucccuccgucccaugauauagcaaucuaauaccagauuggacauuucauaguauaccgaaucuagauaggagggugucuagauucauuguaauaugaaaugucccaucugauacuagguugcuauauuaugggacagaggga

SEQ ID NO: 2089 - RNA, 76 nt, Oryza sativa
uuaggcccagucuuguggcaagaacugaguaguucguuaacucgcuacgugguucuugucacaagaucgagccugu

SEQ ID NO: 2090 - RNA, 74 nt, Oryza sativa
uuguacgagaugugacacauccuaggagacauguccaaauucauaguacuaggaugugucgcauuccguacuag

SEQ ID NO: 2091 - RNA, 310 nt, Oryza sativa
cucaccgggaugggcgcggcggcggaggcggggaagcgugcggcgccgaagucggccgccucgucgucguccgugaugaggagcgauauccgcuugcugagcucggcgaagaacacgucguccuccaucaucuccaccuccauccuuuucuccucuccugcugcgauugaccucgagguuggagaccggagcuugagcuugagcacgagcagcaggaacuaggaagggauuagcacuagcaguagcagcagaggaagaagcagaggaggaggcguugcguuugccuuggccuuugccuauggcggccuca

SEQ ID NO: 2092 - RNA, 103 nt, Oryza sativa
accaacuuaguacgggauguaacacauccuaguacaaugaaucuagauauacauuuguccagauucguugucuagaauaugucacauccaguacuagauuugu

SEQ ID NO: 2093 - RNA, 62 nt, Oryza sativa
uugaacuucggaggagggaauugcucccuguauucaagcaguuccacuauucugaacagaac

SEQ ID NO: 2094 - RNA, 311 nt, Oryza sativa
aaagauauccuaaaaaacugguaauuugcuauagcacacuuucggcucaauugaauugauaaauucuuaagaaauacgagaaugccccuaagaccaaaugcuucaaaaaugauguuagaguaaaaauuuagaauuaugcaacuuuaaauuuuccaucaccccuaaguacaucacuaguauacauuauauuccauguucgcuccagucagcucaaaaguuguugacccuaugggcauucuugucuuuuuuuuuuuaagaauuugucucuccaauugagccaaaagugucauucaacaaauugcgaguuuuuu

SEQ ID NO: 2095 - RNA, 263 nt, Oryza sativa
accucccccgccgccgccgccgccgcucgacccggccgccgacgacgccccgccguucaucuccccugcccccacgccaccgccaccaccaccaccaccaccaccuccaccucccaccccaucacccccgacaacacccccgcccaccccaccaccaccaccacccccaugcgucgggaugucgaaggccaccgcgagaucgggcgugaugagcgacugcgacagcggcaucagcucguccggcgccggcagcugcuccuccc

SEQ ID NO: 2096 - RNA, 91 nt, Oryza sativa
gcuauguguauccauuguggauguagaggccuaauuuuaauccauuuucuaaaaaaaaaaaggcccuagacagcaguggcauaaacucuag

SEQ ID NO: 2097 - RNA, 131 nt, Oryza sativa
cccuccucccaccgccgccgccuccucccgcgucgucgucgcggcgguggccgcgcugcugcucgccgcggcgcuccagccgcugccggucgcguccgggguggacguggcggcggugcucgcggcguucc

SEQ ID NO: 2098 - RNA, 158 nt, Oryza sativa
cccaccuacuuccuucgucccauaauauaacaacccaguaucggauaagauauuucauaauacaacgaauguggacaggagggugucuagauucauuguacuaugaaaugucacauccgguacuagauuguuauauuaugggacggagagaguauuag

SEQ ID NO: 2099 - RNA, 148 nt, Oryza sativa
aaaggaacauuugcaaauuugccacuguuuuuuuucaauuuugcaaagauaccacucgaauaacaguuucaguggcauuuuugcaauuuucuagugacaguuuugcaauaacgauucaaaacaguaguaaauuugcaauugccccuuu

SEQ ID NO: 2100 - RNA, 271 nt, Oryza sativa
uucgacaucauccccucccucaaccucgccaccuccgccgacuaccucaccgcggucgacgacgacggcuaggguuucgaggaggccccaugaccucgccggugacggaggcgaagggggacgcgguggagagacaacagcaguugcuggcgggccucgccggcgacggaggguucaccggugacggaggcgaagggggacguggugaagaggcagcagcagcugcuggcgagccucgccggcgacgaagacggagagggacgcgguggag

SEQ ID NO: 2101 - RNA, 251 nt, Oryza sativa
gguguuucguaggauaggagaguguaccugcaaagaguuuuuuugaacguuuuguggagaaauuagaggggauagguuuuuuuuuuagaaguuaaaaaauuuugaccguuucuuuuggaacuauagauguguucguaggaggggaaacauguugagauugugcguuauuacaacuuugguucugaaaaaaauaaucgcggauuaauuuucuauuucauguuugcuacucccuccauccuaaaauagaagua

SEQ ID NO: 2102 - RNA, 193 nt, Oryza sativa
uggcgaggcgcgcgagguggagaagcagggcacgugcauuccuagagcuuccguccagcuccccggcgggcuagcuagcucacuccgccgccgccgccgccgccgccggcgcgcgcacggcuggcuggcuccggccggcugagaugcaugcacggaugcaugugcccuucuucuccaccgugcacgccucgcc

SEQ ID NO: 2103 - RNA, 68 nt, Oryza sativa
gcucgacuggugcgagccggcggaggugaagcacgucgaccucgccgagcugaugacaccgagagcga

SEQ ID NO: 2104 - RNA, 309 nt, Oryza sativa
gcgaggaggcggcgugcucgguguaguggcccuuggcgaugauccggucgaacagcucgccgccggcacagagcuccaugacgagguggacggcgugcuuguccucguacgcgcccuugagcuccaccaccccgggcuggccggcgaggugguacaugaucugcaccucgcggcggacguccucgacguccuccuuggucgacagcuuccgcuugcugaucgucuugcacgcgaaccgcugccccgucgccuugugggugcacagcgacgugacgccgaacugcccgcgcccgagcuccuugcccacgg

SEQ ID NO: 2105 - RNA, 148 nt, Oryza sativa
aauuuuaccauccuugagaagguaucgggagguaacacauuuucuaguguaaaauuugguacauucagguacuaaaauaccuugaguauaaaaaacuuuuguguaaaauuuagguaccuugagguacuuucucaaggaagguaaaauu

SEQ ID NO: 2106 - RNA, 102 nt, Oryza sativa
ucuucuuucauacaaggaaugcuguguacacauguauucucgcuggggaauuuuuuuuucgccgggaaguguacacauguauucuccuuuuauuuuuugcau

SEQ ID NO: 2107 - RNA, 175 nt, Oryza sativa
uuugcuccaauccagcaaaaaauaccucgagguaccgguacccuacaguaccaaaucguuucugaucguuggaucuaacaaugcccauccugcucagcuagauucaaugaucucaaacgauuuaguaccgugagguaccaguacuucgagguacuuuuugcuggaucggugcaaa

SEQ ID NO: 2108 - RNA, 147 nt, Oryza sativa
ccgaacgaacgcccauccaccaccaccgcguuucaccuuucacgccaccaccgccggugagcugugugaugggccguacuacugcugguguguguugauuugaugcucucacgagcucgugguggacugguggugguguuuguuuac

SEQ ID NO: 2109 - RNA, 309 nt, Oryza sativa
gccgucgacggcgaggagcgacgccaccuccucgaggugccaccccuggagguaggcggcgaccucgacggcgagcagcagcagagacaggacgagggacacccggaugcagccguaggagcgcgcccgcagcgccgugcucucccccggcgcggcgucggcgucgguccgcccggacgccacccugcgccucgccgcggacgcgacggcgagcgcggcggacgcggcgcccgugagccgccccgcggcgcggugcgccuugagcagcagcacccacgugaucuggcgcgcguucuugccgcgcccggc

SEQ ID NO: 2110 - RNA, 71 nt, Oryza sativa
aggucgagaguucgagccucucucaccccacaaaauuuggccgagugaugaugaaaugcuccgugaccgau

SEQ ID NO: 2111 - RNA, 103 nt, Oryza sativa
ccagcuaucuugcgugauccagagcccaucagcaucauccauugggcacaacaacgcuuagcacgggguaacauugaggguguggugaaugcaagcaugcaug

SEQ ID NO: 2112 - RNA, 188 nt, Oryza sativa
gaugccguugauuuuuaagcacacauuugaccauucaucuuauucaaaaauuuacauaauuauaauuuauuuuauugugaguuguuuuauuauuaaaagacuuuaagcauaauuuauaucuuauacauuugcacaaaauuuuuaaauaaaacaaaugaucaaacauguguccaaaagucaacggcauc

SEQ ID NO: 2113 - RNA, 227 nt, Oryza sativa
aaaaguaaauucaauaaaaccuaaaaguaauuuacauauauuauagaaguaacuuauaacaaaagaaaguaacuuuaaugaaugccuuuuuucauaggacaugaagucauauuuuuaucccuacaacgaauuuacuucuaaugucgugacaaagucacguccguuuuguuuuaaguuacuuuuauaauauauguaaauuacuuuuagacuuuauugaauuuacuuuu

SEQ ID NO: 2114 - RNA, 246 nt, Oryza sativa
ggaggaggccgcccucaaacccacguggcucuccccgaggggggucgagcccaggguguugcggcggcugcccccucccagcuuagggucaggccgcccccaaacccacguggcucccccugaggggggucgagcccgggguggcguggcggcuacccccuccuagcuagagggaggaggccgcccucaaacucacguggcucuccccgagggggucgagcccgggguguuguggcggcugccccc

SEQ ID NO: 2115 - RNA, 308 nt, Oryza sativa
uguucguaggaucuuacaucaagauucauguuguuguagaccaaauuguaauuacacacaauuacuuauacuuaguuauagagcauuuacacucaguuucaaugcacuaaaauuagauuuuacaacuguuuuuaucuuuagauuuauggguuuuugacauguuuauauuuuuuauuuauucagaacgguuuauauucauugauuggguuaauggcuuaaugcuuaaugcucuaaauauuaauaguuaggauuaaauguaaaugucaacagacaaaauuggugucgugguguaguugguuaucacguca

SEQ ID NO: 2116 - RNA, 223 nt, Oryza sativa
cuugcgaguugccaguucgcagagggcaaacugcuucaacugacacagcaaaaauggguacuaccucccucccaaaaauguugcuaccuaggauaggauuugaccguuaaaucccauccuagauaguaaaauuuugggacggagaaaguaguaguugguuuugucucaccuuaauguucuguauucuuaggccuacugcccugcuguagcuguaacacuccca

SEQ ID NO: 2117 - RNA, 68 nt, Oryza sativa
uaaaaacacgguggccugggagaucugcuuaacuccggugcagguccaaggcuagccucgaguguauc

SEQ ID NO: 2118 - RNA, 168 nt, Oryza sativa
uccuucccugccaccaccgccacgccgccgacuccccccaugucucugauggcaucaauuccuuuugaccccaaaguccucauugcgcucacgcgcgcccgagcgagagagagagagauaggguaugcucuaagcugggcucguugugguggugguggcuuggauuug

SEQ ID NO: 2119 - RNA, 86 nt, Oryza sativa
agcuucagcgcacucuauauuauaugagauaacaaaagaaagagucaaaggcucaaauccaucgauauggcugcaagacuguuugc

SEQ ID NO: 2120 - RNA, 128 nt, Oryza sativa
gcccaccauggugaccguagaaacuagcauagaaaaaaguagauaucucaagugacuuuguucauuuacguugggauagacaaguaacuaccuuuucuauuuuaguuucuauggucacuuugguggca

SEQ ID NO: 2121 - RNA, 134 nt, Oryza sativa
ggaugcccgguaucugguuuugcgauugggggaugauuuuguaucucgaugacaaguuaagggaccuuggguguacuuuuuccuuugauauauccauccauccauccaaaacgaagcuaaguuaaagagcauca

SEQ ID NO: 2122 - RNA, 131 nt, Oryza sativa
uaguagauacucccuccguccccaaaaaaaaaaacccaauccuguccagauuuaaacauagaauugguuuuuuuuauguccagauucaaauuaagaauuggauuuuuuuugagacggaggguguaguuuuc

SEQ ID NO: 2123 - RNA, 278 nt, Oryza sativa
uacuacucccuccuacccaaauugaucaucauauaguggaaucugaaauuucucaaacugaucaucauauaaccgcauggacaccgguuucaucggaauacaauuaaugcagcaugggauagugugugcaugcuaggguguaauuggcauggucuuuuaaucgaugcaugcauugugggagaaugugugcauggugucuugauugaugugauuuaaauuauccuuggucuuggugcauaaacauauaugaugaucaauuugggauggagggaguauau

SEQ ID NO: 2124 - RNA, 203 nt, Oryza sativa
gcaucgacuuggaccgcgucgacaugagcggcggcggugacgguggaggacgucgucgucgucgacccagccacgugugccuuccgccgccguccuccugcucgaacgacuggucgccgucggugaggaggcgguggagcucgggccgggcgccaccgccgccacucccgcaucucugucgcucgcagucgcaggccgccgcg

SEQ ID NO: 2125 - RNA, 82 nt, Oryza sativa
aaugagucuauagguauugcaacgcaaaccuaaaucguugcaaaugagucuuuagguauugcaaugcaaaccagaauaguug

SEQ ID NO: 2126 - RNA, 119 nt, Oryza sativa
cagccaccaccaccgcgucgucgucgucgacccagccauccaucccacccacacgucaccacccgcgcauccuccccccgugcugcggcggcggcggcggccggcggccauggacaugg

SEQ ID NO: 2127 - RNA, 311 nt, Oryza sativa
cgugcugcggcggcggcggcggccggcggccauggacauggacagcguggagugccucucccucccggacucguccauggacguggacgacgucgacggcggcggcucggugcaccaccaccaccaccaccaccacgcccucccgccucaccuccccgcgggggucgccgucggggucggccccggggggcgcgcguuccccaaggcgaaugucgcugggguuggugguggcggcgccgccggggcccccgcggcggggggagcgguggccggaggugggggccccggcggcgggccucccgccaccagcg

SEQ ID NO: 2128 - RNA, 310 nt, Oryza sativa
gccggcggcggcggcggcgagcucgucgacgacgucggcgcggcagaucgggcaagucgagugcgagcucagccacgcgucgaugcacuccacguggaacaugugcuugcacgccggcagccgccgcaccaccucgccgaccugcaccagccccaggcauaucacgcacugcgcccaccccgacccggccgccgcgccgccguccucgccgccgccgccguucacccucuuguacucgaacgccgggaucgccgacacgauggccgcggcggcgacaucaccgccgccgccgcugcugccggugcuccga

SEQ ID NO: 2129 - RNA, 177 nt, Oryza sativa
ggcgacaucaccgccgccgccgcugcugccggugcuccgagcagccugaugagcccccacgaugaagaccacgucguugggcgccgccgccgccgccgugccgcccacggcggcgcgccgccgccggacccugagguagaggaaggacagcacgacggcggcggcggugaugacgac

SEQ ID NO: 2130 - RNA, 60 nt, Oryza sativa
guaacugacgguaccaaaucguuucacgaucggaaacgauuugguaccaugagguacuag

SEQ ID NO: 2131 - RNA, 67 nt, Oryza sativa
guucauggcuugaggcuaccuaccucggguauaaacagagagggaggguguggccucccuguguuga

SEQ ID NO: 2132 - RNA, 263 nt, Oryza sativa
guccgcguagcuuuucugacgagacugggcggcuuucaacuucucucugauuucagcuacccuuucuuccgcuuccuuuaugaaugcggguccaacuagugcacgcucuccaacuuccgaccacaucagaggaguccugcacuuccucccauagagggcuucaaauggcgacaugcccaagcuugcuugauaaccguuguuguaugagaauucugcauaggguaaacucugcucccaguccuugccauaaguaaggacgcaug

SEQ ID NO: 2133 - RNA, 72 nt, Oryza sativa
cgucgaucgcuugcaaugugcauauugaugacggguauacucuuauucaguaucacuuguaaacuucaucau

SEQ ID NO: 2134 - RNA, 185 nt, Oryza sativa
gcuuuaaguuuuuauuuacaauguuugaucauucauuuuauuaaaaaauaaaaucauuauuuauuuuguuuauagcuugcuuuauuaucagaaguacuuuaaguauaacuuauccuauuuuauauuaauacuaauuuuuuaaauauaagacgaauggucaaacguuacaaacaaaaagucaaaga

SEQ ID NO: 2135 - RNA, 114 nt, Oryza sativa
uccaagcuguagccuccuguugugguugcuagggaacuucaagagaaauuugacaauaagccauccaauccgcaugccuucucuaauacaccacuaggagugcuaauuuuuuua

SEQ ID NO: 2136 - RNA, 71 nt, Oryza sativa
cgguaccgcuugggaacccggcauaggugccggauuucccaaccggcaccuauccagguuuaugugguagu

SEQ ID NO: 2137 - RNA, 101 nt, Oryza sativa
agauugcuucauguuuauaacuucuagaugauuucuauccguaugugauacuauugugugcugaugugagucaaguuggugugaacguguacucgguaugg

SEQ ID NO: 2138 - RNA, 311 nt, Oryza sativa
ccccaaguggucagaguugucucuaaggaaacuaagaaagggauggaaucucugauuaucuuagugguuggcaaauuuggaaauacuggaauggccgcgucuucaacaaugccacaccuaguacuaaugucauauuggaugccguggcaagggagaauuuauuaugguguacugcuaaagcaagagcucuucaugaacucuuggccugauugauucucacuaaggagcuuagcuccucugggaguuguugcgcaucgcuucggcgacucauuuuuuucagaguguuccuuugugaagaacucuguuaugca

SEQ ID NO: 2139 - RNA, 226 nt, Oryza sativa
uucauauuuuaauauaugacuucguugauuuuuuuuuccaacguuuaaucauuucucuuauuuaaaaaauuuauguaauuauuauuuauuuuauuauaacuugauucgucaucaaauguucuuuaaacaugagauaaauauuuucauauuugcacaaaaauuuuaaauaaaaugaauagucaaacguuggucaaaaagucaacgaugucauauauuaaaauacgga

SEQ ID NO: 2140 - RNA, 179 nt, Oryza sativa
gaggaaauugcuggcagcacuguuuauauagaaauuucuguaaaauaauugcuccugagcuuguguuugucauaaauguuaguuguuacuguagauguuucuuuccuuaaaaguuucccuaaacauucuugcuuguuuacaggaauuccuauaugaacacuguugccagcaauuugcuu

SEQ ID NO: 2141 - RNA, 259 nt, Oryza sativa
uccugccuuccgccgccgccgucgccuguuccgccggccuugucgcgccgcgcccuguucccuccgccgccgccgccgccgaggccgccgcguugucgguggcgcccgcuugccgccgcgggacgaagcucucgagcgcgccggcgcucauccccgggccgaacacguucccgggccccgcgcccaccacggacauggcgaugauccucuccauggcucgcacggcacgaccagguugcuggcggcgcggacucgccuc

SEQ ID NO: 2142 - RNA, 292 nt, Oryza sativa
ucucccgagcucucucgugccccguagcgccgccaccgcgccaaccaagccgccgccgccgccggccgacguccagccgcgccgcgccgucguuuuagccgucgccgccaccuccucucaccgccgucgggugcgcauggaagaggggaagcucggccgccccuuagccaucgccgccggccgccguagcgccgucgccgccgcuguccgagccgagccgccgucgagccucgccgccggucgccguucgacgucguccgucguguucguugguaccggugaguucgcaaug

SEQ ID NO: 2143 - RNA, 78 nt, Oryza sativa
uguguuaguucauggcugcugcugcugcuucuucuucagcaauggcggcgaaggcggcgguggucauggcgcuguucc

SEQ ID NO: 2144 - RNA, 72 nt, Oryza sativa
gauugagccgcggcggcggcggcggcggcugcggcugaugcgcggcugcuguugcgguggcccuggcacagg

SEQ ID NO: 2145 - RNA, 72 nt, Oryza sativa
ugcggaucacuuaacaggcccgcacgcaaaaauaauucuauuuucgcgugcgggccuccuaaucuaaccgca

SEQ ID NO: 2146 - RNA, 208 nt, Oryza sativa
ccuagagcuauuaagugcauuuuucuugguuauucgucuggugugaaaggcuauaaguuaugcuguccugaaaccaaaaagguugugauuaguagaaauguugucuuccaugaaucaguuauguuacaugacaaaccuucuacuaauguuccuguuaagagucaggagaaagcaagugugcagguggagcacuugaucaguucagggc

SEQ ID NO: 2147 - RNA, 94 nt, Oryza sativa
gaauguggcaugcuuguugcgcuuguugccccaacuuaagccauaauauauugccuucauuuggcugcucaagcuuaaaaggcaugucauagca

SEQ ID NO: 2148 - RNA, 254 nt, Oryza sativa
auuaauacuacuuccuucccaaaauaauuguaauucuagguuguuuacugcauauuaagcuuugagaagaaagacuauaaugucccuuauuaaaugguguauagguaagaguggaagaguaguugaggguaaaauagggagaaauuugaaugagaagugauuaauggggccauuaguacucuauugugacaauuauuuugggacaaauucaaauccuagaaauacaauuauuaugggacagagguaguaacaaa

SEQ ID NO: 2149 - RNA, 108 nt, Oryza sativa
accuacucccuccgucccaaaaaaaacccaauccuggauuuaaaucuugacauaguauguccagauucaaacccaagauuggguuuuuuuuggacggagggaguaacc

SEQ ID NO: 2150 - RNA, 102 nt, Oryza sativa
ucuggaagcugucguugauccguucucgccggcggcgcuccgagaucauguggugaagcuggcugcugcugggcgguggcggcgguggcggcggcggcggcg

SEQ ID NO: 2151 - RNA, 310 nt, Oryza sativa
acaaccuacgugggcugugguggcgcgcgagcugcuuugccuccgcgacgugcguacuucaccgcucgcccccccccccccccacacacacacacauaauuaacucaucaacuguccuuuugaucaaauuuuacaauguauccgccaaaacuucugauugaucgaacaaggcacgaugaacugcuucaucuacuguagcuugaaauguuucaaccaucgacuuaggagauuguuccuucuuggcauugacuuccucuuagacauguugggugcaaaacucgugucccaccaggcgugccaaagauguguu

SEQ ID NO: 2152 - RNA, 307 nt, Oryza sativa
ggcgagcugguugcgcgacaggucgaugugccgcagcgccgggagcgcgaagauggaggaagggauccaccccugcaggcgguugccggacacguccaagaacuggagcuggcccagcgagcucaucgccgccggaauccugccggugaaguuguugucggcgaggaccagccgcaccaccgcguuccccaccuccgggaacgccgggccgagccuguuguguccgaggucgagcucgucgaggaacgcgagcccggagagguugggcacggcgccauugagccuguuccgcgacagcacgaggcuc

SEQ ID NO: 2153 - RNA, 274 nt, Oryza sativa
ugaguguucgugcgugguucacacgguuguuuuuggugggcggaagucauagaggacauguguuugcccuugguaaguucugaacaaucgaucggaggcauggaguacuagugcaaggcuuucuucuuuuuuuuuugugggguggggugagagguuggugucuguuagauggaucucucuccccuugagcccaacggcucaagggggccuugaaccacgcucugaucgggggcgcccaacccaauggcuggugggccccgucacccugcgccau

SEQ ID NO: 2154 - RNA, 119 nt, Oryza sativa
auauacuuccucugucccaaaauguagcuaccuagugcaguaccuaguccagauucguaguacaagauaacgucauauccuguacuagguagcuacauuuugggacggaggaaguaagu

SEQ ID NO: 2155 - RNA, 84 nt, Oryza sativa
agcuccaggcugaaggcggggcuuguacugcuugugcuucuucaaauuuggcccagcagccccaagcuugucuugaaucaaucu

SEQ ID NO: 2156 - RNA, 102 nt, Oryza sativa
gauaauucauuuuugcuggaagucaucuuaagccaaccgccagcaaagauccauuuucgcuagcggcugacuuaagacgaccgccagcgaaaaugaauuauc

SEQ ID NO: 2157 - RNA, 109 nt, Oryza sativa
gugaaucuaauaccggaugugacauauucuaguacuacuacuaugaaucuggacagauauuuguucagauuuauaguacuagggugugucacaccaguauuauguuggu

SEQ ID NO: 2158 - RNA, 77 nt, Oryza sativa
aagacuaugacaugcgggucccacaauuuuuuuuauuagaaaacagcugacugggaugccacguguacgccacguag

SEQ ID NO: 2159 - RNA, 244 nt, Oryza sativa
gcuacuccguccgucucauuuuaagugcagccaugguuuuccgcgccaacuuugaucguccgucuuauuugaaaauuuuuugaaaaaauuaaaaaccauaagucacaaguaaaauauuauucauguuuuaucaucucauaacaacaaaaauacuaauuauaaaaaaaauucaaauaaggcggacgaucaaaguuggacgaggaaacucaugauugcacuuaaaaugggacugagggaguaauaa

SEQ ID NO: 2160 - RNA, 228 nt, Oryza sativa
uacuacucccuccgucacuuaauauaagguauuuugauauuuuugcuugcacuguuugacaauucgucuaauucaaaaaguuuuggaauuuuauuugugacuuacuuuauuaucuaaagcacaacuuuuuguuuuuuauauuugcacaauuuuuuuaaauaagacgugugcauaaacaggacaacaaaauaucaaaaucccuuguauuaagggauggagggaguaaua

SEQ ID NO: 2161 - RNA, 76 nt, Oryza sativa
uuaggccugaucuuguggcaagaacugaguaguucguuaacucgcuacgcgguucuugucacaagaccgagcccgu

SEQ ID NO: 2162 - RNA, 309 nt, Oryza sativa
cuucgcuucgucccccgcaucgacacgcacgcacaccagcagcacaagcacccaaacccuagcucgcggccgcggcgaauccugcgcgcgcgagagagaccccggcugaugguuucgaugagcgcgacgcccaauccgaucgaugccuccgucgucuccgccgccgccgccgucgcgggcggcgggggagguggggaugggggagggggaggaggagggaaggagaaggagaagcaggugguggcugcgccgcugcagccgccgauggccgugccugcaccggcggcggcggugggggaggaggcgagg

SEQ ID NO: 2163 - RNA, 83 nt, Oryza sativa
gcuccaggugcucgccgacggcauccaggacgacgccgggaacgugacgcgguucgugaugcuggcgcgggagcccaucaucc

SEQ ID NO: 2164 - RNA, 81 nt, Oryza sativa
uucgccggcggcgcuggcgcgucgucgaacaccuccucgcugcugucccucuugcacgacgccgccgccgccaccaccggc

SEQ ID NO: 2165 - RNA, 68 nt, Oryza sativa
agucaccuaagucacugacaugugaguuuucuuugcuauggaccaacguaucagugacucuaaagucc

SEQ ID NO: 2166 - RNA, 81 nt, Oryza sativa
uggcggcguucgcggcgguggcgguggcguuccugggcgcgaggaaggggugcucggcguggcggucggcggcgcggcggc

SEQ ID NO: 2167 - RNA, 102 nt, Oryza sativa
auaaucgauuaucccgugcgguccacuuaagacaacggcacgggauaauuucuauuaucccaugcgguuguguuaugcggaccgcacgagauaaucgauuau

SEQ ID NO: 2168 - RNA, 62 nt, Oryza sativa
ccucuccuccugggccgccucggcuucgcccggcccaagccgagccgcgccucccacccaug

SEQ ID NO: 2169 - RNA, 231 nt, Oryza sativa
ucccuuugauguccugcuguugcacuguauggacauaagaaaagaguauuucaaugcaggugauuguacuuaaugcaccuucggacauaucuuauagcaacuauugaaauacuauuugguaucaacauugauaggcuuuucuuugcucaaaaacuaucagucugugcuucaaggauuaggcgacaugggagcaaagauuucuauggugcuacagcaggcaaaacacaggaa

SEQ ID NO: 2170 - RNA, 90 nt, Oryza sativa
aggccuacuuuggaacggaggaauuuuauaggauuuuugcgggaauuuuaacagauuccuguaaaauucauucguuccaauguagcccua

SEQ ID NO: 2171 - RNA, 83 nt, Oryza sativa
uaaaacaaccuaggaugggaugggacauauccugucuagauuuguuguacuaggauaugucccaucccauccuugguugcuuu

SEQ ID NO: 2172 - RNA, 202 nt, Oryza sativa
gagauagguauaggcaugaaauacauucauaccaaaucucaacuuaaaacuuaacuuuauuugagagaaaaaaaauacaaauuugaggugaauuguaacagaacacuauucacaaaaaaaauuucauuuuuguuucuaucaaaugaaguugaguuuggacuuaaauuuugguaugaauguauuucaugcuuauaccuaucuc

SEQ ID NO: 2173 - RNA, 310 nt, Oryza sativa
acuacaggaauacaugugcaaaccuauggauugaaaaacacaggaauuuuuccuauguuguugagcaagccaaccaaaggaaugcaaacauuagguuggaguggauuauuuuucccuaugcuuuuccuucaaaaauggaggaauggaaaacuuuccuacaguuuuccuauggugcauucauaugaaacgaaugguaguuuaaaacccauuccuauuccuauacuuuuccuuugcaauuccuuugaaacgaauaagcccuaguguaggaaaaauuccuguguuccaauccuuuguuuugcacguguauucc

SEQ ID NO: 2174 - RNA, 137 nt, Oryza sativa
aggcggcggcucgggcucggcuugggcgaccagccggcuggagguaggggauggccccgacaugugggccccacaugucggcggcuaggggaaaggaggggcaagcgggucggcugggccggcuugggccgcucggc

SEQ ID NO: 2175 - RNA, 308 nt, Oryza sativa
gacagaaaaaucgagaguuuguguguauaggaaaguuugaugugacggaaaaauuaaaaauuugaagaaaaaaguuggaaacuaaacaaacccuuggucaacugcaguaggcaacuggucagauccccacaaaaaaaaaucacaaggcauccagucagaccgugguaugaauuguuguccgaccgaccuuugcgaaaaggcucugacuccuuucuaaggcagaguuuaguuuuaaaauuuuucuucaaacuuucaauuuuuuucaucacauuaaaacuuuccuacacacacaaacuucacuuuuucau

SEQ ID NO: 2176 - RNA, 207 nt, Oryza sativa
uccaccacguacucgaucuugaaccaaguggcccaaaccacaucacguuagagccgccgcuguucuccucacuugguggcgaaguuguggauauaccagccuguaugcgacacguuacuucauccuuauagcuuuaagaaaugcggcauuagcaguguuuucaagcuccaccaccucuugguugcaugcgaucgaguuguaaucuca

SEQ ID NO: 2177 - RNA, 263 nt, Oryza sativa; identical to SEQ ID NO: 2132

SEQ ID NO: 2178 - RNA, 68 nt, Oryza sativa
accucugguguagacagcuugcuuuugugcacaccggcugaacccaagcuccuucauacuccagucaa

SEQ ID NO: 2179 - RNA, 78 nt, Oryza sativa
gugggccggccggcgcggcggcuggcggcuacgcggcggcggggcgcggugggccggcuggugcgccggcggcgcgac

SEQ ID NO: 2180 - RNA, 93 nt, Oryza sativa
auuaguuguuucucucagugguaucaugguaucagagcuacucauaagaguuguugcugugguaccauguuaccauugaaggaaacaacugau

SEQ ID NO: 2181 - RNA, 71 nt, Oryza sativa
ggauaaguuuuuuuaggggucuauuugcgaaauaaguuuuucaaaaggaccaaauugugaaaaauccagaa

SEQ ID NO: 2182 - RNA, 197 nt, Oryza sativa
guucaaguucucggccaagcacuuuugcugauagccuuuggcccgggggagaacagacgcgaagaggaaauacuguucgacaucgucgacauccuguacaacuacaacgccaucuucaaccgugcaacccugaacaaguucgaagccauuucccaccacaauuaucucaagcucaagaugcucggcccgacaggggu

SEQ ID NO: 2183 - RNA, 302 nt, Oryza sativa
cgcuuaaguauuugcauaagucgaguguagcgacgaucgguauguuuuccgaaaacgagcugucgcgguuucaacguucggcgagcugugcuucggccgauucguaucggcccccuggcguuuucaucgaucaaauguuugccuugggguuuuuccacgaaauaucauacacaaaaauggcgaagacacccaugaauuuuauaugacuaagcgucaguuugccauugcccagcgucgacgcagcauuauccccguuuuuccuucuucaccgcuaaauuuuuuuuuguguugaucuaacaacu

SEQ ID NO: 2184 - RNA, 67 nt, Oryza sativa
gucucuaugcuggcgucgucgaucuugucagaagagcugaaguagucaacgaucucaguagacgagc

SEQ ID NO: 2185 - RNA, 147 nt, Oryza sativa
uagagaugccucacgaaccccuuccagugucuagaucgaucgggcgauugauuuagguuugagauuagagagagaucagucgucaucugccuccuuccuucucuuucuuuauauaggcgacacugguggggcucggggguuaucuca

SEQ ID NO: 2186 - RNA, 304 nt, Oryza sativa
augcaccuuaguuaaaaacacuccaaugaucaauccuuuguuuaaaucaaagacaaagaaagagagagggaguauaaaucaauuuucacccuagaaccuaaccauaccucuccauucuccuaggaagucacuaaugggaccccuuggcacccucucauucuagcauagauaaaguacaaacugaaauuuagcacuaaacacagcccucacacccaaaaucgugucuaugucuaagcuugccaccuaaccccucccuuccaacucaacauccaucacuuaggguguguuugguucauggucaaga

SEQ ID NO: 2187 - RNA, 70 nt, Oryza sativa
cgugcggacccuuaagaggcccauacgcgaaaauugauuuucacaugcgggccucuuaagggucggcacg

SEQ ID NO: 2188 - RNA, 205 nt, Oryza sativa
caccacgucccagcucgccaccucggccaccggcuucggcaucgccgacaggucggcgccgucgucgcugcuccgccacggguuccagggccucaagccccgcagccccgccggcggcgacgcgacgucgcucagcgugacgaccagcgcgcgcgcgacgcccaagcagcagcggucggugcagcguggcagccggagguucccc

SEQ ID NO: 2189 - RNA, 74 nt, Oryza sativa
gggugugcgguaccauccaaucucagccauccgaugagggcauaucaacggucaggauuugguaccgcccaccc

SEQ ID NO: 2190 - RNA, 63 nt, Oryza sativa
cgagguagaggcagcacauugaccgugaugggauacggcaugauguaguugucaccaaccaag

SEQ ID NO: 2191 - RNA, 177 nt, Oryza sativa
caacuuuuagguaauguuuggcuaaugggaaagggaaaugauuuaccacccaucaaaagacaucuuuaaauccuaaccguucauucucucucuuccauuuaauccaaacccuucauucauuucccaaucccaaucccacccucuauuuccuauuauccaaacacacccuuaugucuu

SEQ ID NO: 2192 - RNA, 93 nt, Oryza sativa
ccauaacuggucacgucugcgaaaaucguccuccauuuuugugugcagcucaccgcacguaaaaaucaauuuucguagacgggccucuuaaua

SEQ ID NO: 2193 - RNA, 158 nt, Oryza sativa
aacccauaugucagucacauauagaaaaaauuaaaaauuaagaacauauuuuuuucuccucucuuuuuucauuuauuuuuuucaaaauuaaagacaucauuuucuccuuuaucucucuucucucuuuuuaaauuuuuucuaugugacuaacaugugga

SEQ ID NO: 2194 - RNA, 273 nt, Oryza sativa
acaaagcauuucuccacuaguguaugcuguuaaauuuuuuuauaaauuugaugaaacuuaagaaaguuugauuaggaaaaaaaaaucaaacaucuuauaauacgagcagggaucaguggaggauuuaccuccuggggcagcacgcggcugcccgggugucaagcgcucgacccaucaaggcgcagcgauuuguaugcgguaaaauccaccgauuaacugucuucccaggcaacuagagcauguacaaugguauuuauuaguggucucucucua

SEQ ID NO: 2195 - RNA, 104 nt, Oryza sativa
accaaccugguauuggaggugauauucccuaguauaacgaaucuaggcaaccuucuguucagauucguuguauuaggaaauaucaccuccaauaguagguugau

SEQ ID NO: 2196 - RNA, 75 nt, Oryza sativa
aauaaaggauugguauauggauaaaaguugugaacgguguuucaugaaguaaauccaaguguaucucgaauaauc

SEQ ID NO: 2197 - RNA, 66 nt, Oryza sativa
guaccuuuaucacuaacuuguggauccagggaucaucggauccacauguaagugacaaaguuacgu

SEQ ID NO: 2198 - RNA, 275 nt, Oryza sativa
accucgccggccgccgccgccaccuccucccacgccgccuucucccucaguaacagguucucgcacaccagguacccuuccaccggcuucaccuucuccggcuccggcccgaguagcgcgccauggccgggguacuugagcuacggggcgucgcuauccgcucacccguacaacgccggcggcggcaagagcucgucgucguucgaggcugcgcugagcagcaucaacggaagcaggcagcagggcggcggcggcgguggcggcucggcgccgcc

SEQ ID NO: 2199 - RNA, 184 nt, Oryza sativa
ggcagcagggcggcggcggcgguggcggcucggcgccgccgcucuaccagaugcagcagaaggcggcggcggcggcgccgccgccgccgagcgugaucaccgacacgaucgcgaaggcgaucacggcggacccgagcuuccacacggcgcuggcggccgccaucacgucguacgucggcaagaa

SEQ ID NO: 2200 - RNA, 258 nt, Oryza sativa
cgugccggugagcuccgccgucucggcgaccacgcuccgcaucuccuccgcgucguugucgucgccgguccaccgccggcccaucaccaugcgggagacgaugucgccggugaggcccaugagcgcggcgucgacgucgacgcgcucgccgccgucggcgcucgcgcggagcgagccgacgaggcgcgccaccuccucgcggcggacguggcggagccggucgagcguucguccggcgaggagcucgugcacgcacgc

SEQ ID NO: 2201 - RNA, 303 nt, Oryza sativa
ccgccuccccucguuuacuauuggucgccgauuaacccccucuucuccuccucagcgccgccgugccaagaagccgccgccgcgccgccgugcugagaagccgugcgccgugcgccugccgggacucgucgucgccgugugccgccuccucugcucgucgucuccucuccagguaccccucucucucucaugcccaugaauggaauggugcaguggauggaugaauaaaugaugcaauggaauggaugaaugaaugaugaacuuuggaugaaugaugaacuuuggaugaaugaugaacuuugg

SEQ ID NO: 2202 - RNA, 108 nt, Oryza sativa
agacaacuagucaccugugacgggccggaagugaaaaccguaaaaggugagguuuaccucaccucugacggguuccauuuucaacccgucacaugugacuaguuacuu

SEQ ID NO: 2203 - RNA, 104 nt, Oryza sativa
uuuuauaauauauguaaauuacuuuuagauuuuauugaauuuacuuuuauaugucuaagaaguaauuuaguuaaaucuaaaaguaacuuauauauauauaugau

SEQ ID NO: 2204 - RNA, 310 nt, Oryza sativa
augacauuauugcgccggucgugucauccacacucgcgccaggcgccucugcugcagcugcagcugcaccggcgguggcaccgccggcggcggcgcuugaagcgaucuugaucccgaugccgccgccugcagccgcagccgcagcugcugcaccuguacccaagaagaggaagguccggacagccucaacccucuccggaagugguggaccaggacgaggacgcgggcguguugccgaggcaaccuuugucggucguggccguggaguuuggagugugcgcgggcgcggacgcggacgcauuccgacuga

SEQ ID NO: 2205 - RNA, 230 nt, Oryza sativa
auauuugacguuuagaacaagauuuggucaaguuuuggaaacuuucacagucaauaaauuucucaaaugcuuaguuuaaaaacaaaaagaauggcauacacaaaauauuugccucagaaaguaauaucauaauaucauaagccuauuagauuuaugaacuuauucuaauauaaaauugauguccggaauuuuagaaauuugaccaaaucuuguccugaacaucaaauauu

SEQ ID NO: 2206 - RNA, 59 nt, Oryza sativa
uucggaaagggauccucugacuuaacugcugcaguuaagucagaggaucugcuucccga

SEQ ID NO: 2207 - RNA, 237 nt, Oryza sativa
accaucacccuugaggucgagucgucugacaccauugacaaugucaaggccaagauccaggacaaggagggcauccccccagaccagcagcgucucaucuucgccggcaagcagcuggaggauggccgcacccuugcugacuacaacauccagaaggaguccacccuccaccuugugcucaggcucaggggagguaugcagaucuucgucaagacccugaccggcaagaccaucacc

SEQ ID NO: 2208 - RNA, 178 nt, Oryza sativa
uauuaauuuaaaucguugggaccucagcgccaaguuauuuggcacugagcuaugaugacucagcguacucacgccaccucggauuagagcuuagcgcaaaugacguuggcgcugaaacguuauagcuuagcgccaaagucaauggcgcugaguccacggccuauuuuugguuaaaauu

SEQ ID NO: 2209 - RNA, 276 nt, Oryza sativa
aucauugguaucgugguccaacaugauagugucaaugacauuggcguuguucccggagaagcuaauucacuuauaugaagagagaugguaccaauaucauuagcgcuaaggaccugcuuguaaaaaaauugaaaaauaauuuauuuauaauaaaaauauuuacaaauccucagcacaauugauauuggcgugaccccucuucuauaagugacuuagcuccuccggggaguauagagguuauuggcgccguuaaaauuggaccacggugcugaaaaa

SEQ ID NO: 2210 - RNA, 248 nt, Oryza sativa
uacauaucccucaaccguaaagccgaauauaguguaucccucaacuaccaaaccaauccaaaucaaguccccaaauaguacuaugagcgguuucgauucauauaacaucuuauugaccuagucuucaucccauauaauaucgugaugauauuaacauggcacuaaaaaauaaaaauaaauaaacaccgaugaacaagauauuacaugggaugaagauccuguaguucgguuaacguuuaaguggaacu

SEQ ID NO: 2211 - RNA, 256 nt, Oryza sativa
gcgcggggaggaggccgaugggccgcggggagaggagagagagggagggagaguugggccgagccggcccaagagaggaaggggggggaaaagaagacuuuuagagauuuuucuuuuuauaaaccuuuucaacuuuguuuauuucuucucaauuauuauuugugcucugaaaauuccacuaaaauuugagggcucuuuuuagaccaaggagaauuuaacaaaaauucuccgggcuacauuugaauuuuucuuguac

SEQ ID NO: 2212 - RNA, 176 nt, Oryza sativa
ucauaaucagcucaacacuucacagccgugcugccaugcauugcagguuugcaacaaguuacauuacuacuacucccuagcaauuuucugguaagcucagaccaagcgacuaaaucaaucaggcgcgcucaccgcggauccggcgcgcgagcuggauguccuugggcaugauggug

SEQ ID NO: 2213 - RNA, 88 nt, Oryza sativa
ugaugagauguuguagaucugaacaaguguaaacaauauggaugcuuuguuguuugauuuuauucauucgaucuaugauugauuuagg

SEQ ID NO: 2214 - RNA, 183 nt, Oryza sativa
uuugacuuuuuugcuugcacuauuuaaccacucuuauuaaaaaaauuugugcaaauauaaaaaacgaaaaguugugcuuaaaauggaguacuuuggauaauaaaguaaaucacaaauaaaauaaauaauaauuccaaauuuuuuuaauaagacgaauggucaaacaguguaagaaaaagucaa

SEQ ID NO: 2215 - RNA, 246 nt, Oryza sativa
acucccuccguuccaaaauauugcaaccuaggaugggucuacuacgaaucuggacaaagauucguagaugagacaugcugcugaaacgugggcagcguuuguuguugauacgacuccugugaguugugacaccuaauccuugcgaugauggaauggaaaaauugacaccuaaucagauucguauuacuaggaugggucugaucccaggcccauccuagguugcaauauuuugggacagagggagua

SEQ ID NO: 2216 - RNA, 65 nt, Oryza sativa
uuuaguuggaugggacauauuuauaguacuacgaauuuggacagaauaugucucauccaaccaaa

SEQ ID NO: 2217 - RNA, 97 nt, Oryza sativa
uaacauacuauacucucugauaugggucgcugauauguaaaccuguugguuauaagguccacaugccagccacucaaaguuagagagcaguacguca

SEQ ID NO: 2218 - RNA, 277 nt, Oryza sativa
auuacucccuccuucccaaauugauaaucauauauggaauacacaauuucucaaauugaucaucauauaacugcauggauacggauuucaucggaauauaauuaauguagcaugggagaaugugugcaugcuaaggguguaauuggcaugguguuuuaaucgauauauacauugugggagaaugugugcaugaugucuugauugaugugauuuaaauuaucauuggccuuggcguauaaacauauaugaugaucaauuugggauggaaggaguaaug

SEQ ID NO: 2219 - RNA, 84 nt, Oryza sativa
aagcuaauaguaccauauugaagagugugcagaagauuuuaauuacauuagauaugcacauaauauaauugguguuauaguuuc

SEQ ID NO: 2220 - RNA, 125 nt, Oryza sativa
ucguacuacgaucugauacauucuaguauaacgaaucuagauguacacauucuaguauaacgaaucuagauguacacucuacaucuagauuuguuauacuaggaugugucacauucuaguacuau

SEQ ID NO: 2221 - RNA, 60 nt, Oryza sativa
ccacgggcuucucgccgguaccgccaccgucggcggcggcagcggcgggggaggccgcgg

SEQ ID NO: 2222 - RNA, 130 nt, Oryza sativa
caaccuuacuucccaucauacgcacugcaagcuuagcuuggugaggaucgaucgaucggagaagaucaucagauugauaauuaaaguaagaaaggucgaggaugcaggcggugaaggagaaggugaagga

SEQ ID NO: 2223 - RNA, 95 nt, Oryza sativa; identical to SEQ ID NO: 1759

SEQ ID NO: 2224 - RNA, 69 nt, Oryza sativa
agcucaucccuccagucgauggcugugguccggaggaggggccaugcaaugaggaugggggcgcggagg

SEQ ID NO: 2225 - RNA, 194 nt, Oryza sativa
cgugcccaucaccauggggcuggagcgcaaggagcucgcggcggagcucaagguccacgacgguggugggagcggucggcgaugcgggcggugggccuccuacugccuggauccggcggcgguuggccuccucccgcccggauccggcggcggcgagccuccucuugcccagauccgucggugguagcggaugg

SEQ ID NO: 2226 - RNA, 127 nt, Oryza sativa
uucuauuccauccgucccaaaauauaaaggauuacgaaucuggauauagagccuaucuagauucauaauacuaggauauguucuauccaacuaaaauuucuuauauuuuagaaaugguggaguauau

SEQ ID NO: 2227 - RNA, 154 nt, Oryza sativa
ugcucccuccguccuauaauauagcaaucuaguauaagacgagauacuucauaguauagcgaaucuggacaugcuucaugucaugucuaaauucguuguacuauaaagugacccauccgguucuagguugcuauauuaugggauggacgaagua

SEQ ID NO: 2228 - RNA, 79 nt, Oryza sativa
ccuugaggaguaaauuuugguaccucaugguuccuuauaguaccuagguaacaugauguaccaaauuuacaauagaaaa

SEQ ID NO: 2229 - RNA, 299 nt, Oryza sativa
agagagagagauggcguuguguggcagugugggauggauggauaagauaaaggaugucguguggauggcgcuguggguggucaaaaaagccggcuugguuuuuuucaaaggugucaguuccguugaaaaaccgacaccuauacuauaggugucaauuuuuuuaauagaaccgauaccuauauuuguauuacaggugucaguucuguuggcaacuuuuuguaacaaguugacaagcacgaucgcagcaccuuaagcuuugcggugauccuagagucaccaacgaccucaaucuagccaaa

SEQ ID NO: 2230 - RNA, 90 nt, Oryza sativa
auauaucuaaauuacuuuuauuuuucuuuaaauuacuucuuagacguaaaaaaguaaauucaauaaaaccuaaaaguaauuuacauauau

SEQ ID NO: 2231 - RNA, 65 nt, Oryza sativa
ugauauaugugggcuguuuuuuguuggugauaaauggccaaugaugaaugcuuaagaacagauca

SEQ ID NO: 2232 - RNA, 170 nt, Oryza sativa
acuuuuugacaacguuugaccuuucgucuuauucaaaaaauuuguauaauuagaauuuauuuuauuuugacuugauuuaucaucaaauguucuuuaaacaugauauaaguauuuuuauauuugcauaaaauuuuugaauaugacgaguggucaaacguugauuaaaaagu

SEQ ID NO: 2233 - RNA, 251 nt, Oryza sativa
auuauuuuuuugugauuuuuauuuucacagacgaucggcuuaagcgcccgcaugccuuaggaucgagaugucgacuagaggaggcugaauaggcgauauuaaaaauaaaugauaccuaaucaaaacaaaccuaaagugcgagacuuggugaaggauaagacuaacuaagcaacuagauuaaaguuuugcaauccuagggugauaagggcucaaguauguuucuaugaauguaaauugcacaaaaguaaaug

SEQ ID NO: 2234 - RNA, 91 nt, Oryza sativa
uguaaaucggucugaccgagguugauccgccagucugaccgcgcucgugccgccggucugaccgguguugaucacucgguccaaccgccug

SEQ ID NO: 2235 - RNA, 79 nt, Oryza sativa
uccggcagcguagaguaccguggaguagaccuguaggaauucuuccgggucgguacucccaucguacuucucuauugcu

SEQ ID NO: 2236 - RNA, 112 nt, Oryza sativa
uccagaguugauggcgauggacauggugcgaaaccaauggguggacucaccuauugaauauugccaaucaguggcgagcgauggcaccaugucuggccugucugaagggagg

SEQ ID NO: 2237 - RNA, 73 nt, Oryza sativa
agugagccuuuuaagaggcuugcaugcgaaaauaaguuuaucuucacaugcgggccucuuaaguggccugcau

SEQ ID NO: 2238 - RNA, 265 nt, Oryza sativa
gaguuugaaggaaggaguugauggugggauuggucaugggaguuacuuuuuuaguccccaucccuuguuugguuucacaucgaauucccucuaagucucacgaauuaacaggccucccccagguaagagauuggugggaauuggaccccuuaauuccccaucccaaacccccucaaauuccuaaguuuuccaaccaaacuacagacuuaaacucccauauaucauaaacucccauuccccaucaccaacucccuccaaccaaaca

SEQ ID NO: 2239 - RNA, 310 nt, Oryza sativa
guauauucugcacuauugcugguucuaucggcugauguacuaugguaauauucccugguuagucugcauuuuacuguuuuuuguuuagaaauauuauuuacacauaauuuuuucuuugcuuagguguuggguacacuuaaauuuauuuugauuuuguagaugucagagaugcaugaugucacuuacucacuuccaacaugaaauuauugucccuuacaauuucuugcaacuugcaacuucuguuauaaacuuacucuguccggucaaauuauuugucauuuagagaugcacuugauagugcaguggcaag

SEQ ID NO: 2240 - RNA, 79 nt, Oryza sativa
aaaauuuuaguaaauuuugguaccucaugguaccucauaguacuuagauaccaugagguaccaaauuuauaauagaaaa

SEQ ID NO: 2241 - RNA, 145 nt, Oryza sativa
auugcuuauuugaccccguuuugaacccuaacuaccaauuugacccuacuuuucagaguuugcuuauuugacccuccuuuucaaaaacgaagcccccguaugacccuguucuguuaagggcaucuaacgguguuaacugaagcau

SEQ ID NO: 2242 - RNA, 65 nt, Oryza sativa
gccggcuccucgucgucgucgucguugucgucaaggcgcggcgguggcgguggcgaggaagacga

SEQ ID NO: 2243 - RNA, 134 nt, Oryza sativa
cguaccuaugguacuagaucugguaucauagguaucaaccagauaugauaccucagguaucaaguaucggaucaaacgguacuccaaguauaugaucugauaccuaugguacuagaucugguaccuuagguauc

SEQ ID NO: 2244 - RNA, 177 nt, Oryza sativa
auuugcuccggucuaacagaaaguaucucgagguaccgauaccucgugauaccaaaucguuucugaucguuggaucuaacaauauccauccuguccaguuagauccaacgaucggaaauaauuugguacagugagguaccggcaucucgagauacuuuuuguuggaccggagcaaau

SEQ ID NO: 2245 - RNA, 111 nt, Oryza sativa
aaugaauaauuuucacuagccuuugaucacuggcgguauagccggccacuagcgaaaaccuauuuuggccgacaguaaaaacaguuuuagaaguagugagagcacccgaua

SEQ ID NO: 2246 - RNA, 158 nt, Oryza sativa
ccggucuguauaacacaaccgccagcgaaaauuauccaucuucgauagcggugcaccuaagugaccgccagcgaaaauagacauaucuucgcuggcggcuaguauagcgugaccgccagcgaagauccauuuucgcuggcggucggugccccuuaccc

SEQ ID NO: 2247 - RNA, 232 nt, Oryza sativa
cagguuauaagauauuuugacuugggucaaagucaaacuacuuugaauuugacuaaguuuaugcacaaauauaauaauauuuauaauaccaaauuaauuucauuaaaucaauaauugaauauaguuucauaauaaauucguguugaguugaaaauauuauuauuacuucuacaaauuugguuaaauuuaaagcaguuugauuuuguccaaagucaaaacgucgggaguaucu

SEQ ID NO: 2248 - RNA, 132 nt, Oryza sativa
uacagaaauauaccgucggucucgcacaaccguuacgcgaaagugcgcuuucccuaagcgauaccgccugcgacgucauucccacgucacuuucgcuuaacgguugagcgagaccgacgguauauuucccua

SEQ ID NO: 2249 - RNA, 81 nt, Oryza sativa
cggaucaggaugcucugcagucgacugcaccgcaugucaauaauaaaagcgcggugcagucgacugcagaggaucuuaauc

SEQ ID NO: 2250 - RNA, 291 nt, Oryza sativa
aaugucgacuuagaaagugcccucguguggagccccauugucucgucuggguaggguaguaaaggacauaauuuuuuagccuauaaaauuugaagaccaugucuaaaauggaguggacuuguuuuauauauuauuuuaaucuagaaauauuuaagggcuagguaggguugugaaauagccuauaagccuugaccuauuaccacuacuacaucaaaauuacuuuuuucaaaacccauuuaagccacuaugaauugagaagggauauccgugaggcuacuuuugcacucuaaa

SEQ ID NO: 2251 - RNA, 93 nt, Oryza sativa
auuuuaguuggaugaaauauauucuaguacuaaaauucugaagaggcucucuauuuagauuccuaucacuaggaugucucauccaacuaaaaa

SEQ ID NO: 2252 - RNA, 59 nt, Oryza sativa
aaauuucggggggggggggcgccagccacucuggcgcacucccuagccaccucagcauc

SEQ ID NO: 2253 - RNA, 92 nt, Oryza sativa
gaauuacuaccucugacacaaaauauaagcauuuuuaacuguccagauucauaguuaaaaaugcuuacauuuugagacggagguaauauuaa

SEQ ID NO: 2254 - RNA, 256 nt, Oryza sativa
guggaggccgccgccgccgccgcugcugccgcguggacgggcaugaaguggucgaacgaguagugcgucaucuccgcguggugcucggcggcggcgggugugagggugaagugcugcgcgggcgccauggcgaugggggugauguuggcgagguggggagcgggugaugcgaaggugugcggcaucgcggagugauggcccgcggcggauuuccgcggcugcguaugcggcgcggcggcggcggcgaagccgaugu

SEQ ID NO: 2255 - RNA, 132 nt, Oryza sativa
gagggacccguugugucugguuuuucgguugagggacgaaaaucagauucguuggcaaguuaagggaccucagaugaacuuauuccgucacaaaaacaagccugcaccgagaagccaaccagccagcccaau

SEQ ID NO: 2256 - RNA, 273 nt, Oryza sativa
aaaaaaauagcaugcaauauguucggauuaguuuuauaauaaaacacuugauuaguuucuuauuaugauuguaagucuuuuccuacuaggacuuauagauuucucuuuuacaugucucuuguaagcuacacgagaagggugcgacaacccagugugucgugcguuuguauucaacuucucuauaucgaucauugcuagucgguguccgugguuuuuucccguaaggauuuuccacguaaaaauuuguguguaugugugcguguguguauagaa

SEQ ID NO: 2257 - RNA, 84 nt, Oryza sativa
gugugaaacuggcaugugggucccauggguuuuauuauuuuuuucgaucgaauugccacguaggcgccaugucaaugccacgcc

SEQ ID NO: 2258 - RNA, 179 nt, Oryza sativa
uuggagauaguggcaauggcauccacgacggcggcgacgagcuauggguauugaucugcucucuccuaacaugcucacccucucucucaaaaaccuuagcaaguagcggguucagacauacuuugcuucacaccucucaucgcugcuucugucgcugcuugccgugggcaucuccaauu

SEQ ID NO: 2259 - RNA, 191 nt, Oryza sativa
gagauagguauaggcaugaaauacauucauaccaaauuuuaaguccaaacucaacuucauuugagagaaacaaaaaagacaaauuucgggugaauaguguucuguuacuauucaccucaaauuugucuauuuuguuucuuucaaaugaguugagauuugguaugaauguauuucaugucuauaccuaucuc

SEQ ID NO: 2260 - RNA, 311 nt, Oryza sativa
aaagacauauuaaaaaacugguaauuugcuagaugauacuuucggcuuaauuggauugauaaauucuuaauaaagacgagaaugucccuaacaccacaugcuucaaacaugauguuagaguaaaauuuuagaaaguaugcaacucuaaauuugccaucuccccaaguauaucacuagcauacauuauauuucaccuucgcuccagucucagcccaaaggcuuuugacacuaggggcauucuugucuuuuugaaaaaaaauucccuccaauugagccaaaaguguccuccagcaaauuaucaguuuuuuaga

SEQ ID NO: 2261 - RNA, 88 nt, Oryza sativa
aacaagguaguguucucgguauugcuccucgucguucucuccgugcucgcggcggcgauggcgaccauggcggaccaccaccaagucu

SEQ ID NO: 2262 - RNA, 77 nt, Oryza sativa
ggagaagagaguuagagaggauagaucugaggagagggggugagauucgaucugucuacguuguaacuguggaggag

SEQ ID NO: 2263 - RNA, 68 nt, Oryza sativa
ugaccgcccuuacgccgccggucggaccgcugcgaugccgccggucugaccgccgcugagaugccggu

SEQ ID NO: 2264 - RNA, 80 nt, Oryza sativa
cuuuauuguuuaugcauguuuuggguguguucauguaccucucccccugcgucaccugaaugcugcuauguucaaugucc

SEQ ID NO: 2265 - RNA, 167 nt, Oryza sativa
gcccccguucuuucacuuggcguugauggagcaggugguagcgccgccgccggggcuucagccuccgcggaacggauugugacagcuguggugagggucuucgguagcccucugcgucagccgguuguuucgccgcuagucaaggcgaaggggaagggugcagccgu

SEQ ID NO: 2266 - RNA, 94 nt, Oryza sativa
acuuuaauaucauucauauauauauauauauauauauauauauauauauauauauauauauauauauauauauauaugaguuggauuauuugca

SEQ ID NO: 2267 - RNA, 160 nt, Oryza sativa
uggaugcggcguucaaguugucguucccggcggugguggcguccaagucguuguucccagcggcggccgaguugacguccaggaggaggcggcggcggucgaucccggcagcggcggaguuggcgucuaggcggcgguagcggcggcggcguugauggca

SEQ ID NO: 2268 - RNA, 65 nt, Oryza sativa
cuugguguguuugguugggcauuucaaucuugcaaaagcuaaaagccaaccaaagaaccuaaggc

SEQ ID NO: 2269 - RNA, 237 nt, Oryza sativa
gcguugacguggcaugccacauguacaugacauggcauuauuuugacugacaaaugggacccauuuaaaauuuucccuuuuucuuuuuuucuucucuuuuccccuuucuucuccuucaucuaucauccgugcagaaaaaaggaaaaaacagaagaaugagaagaaaacaaaaaagaaaaagaaaagaaaaaaaagaaaaggauacgucacguccauguggcauugccacaucagcgu

SEQ ID NO: 2270 - RNA, 98 nt, Oryza sativa
uucguccaugucaucacgaguuaaaauuuaacuccauuaaaauuuuaacuucugaguaaaucugcgaguuaaauuuuaacuccgaugaugcggcugcc

SEQ ID NO: 2271 - RNA, 261 nt, Oryza sativa
uagugaaacauuaugaguauacuaggugaaauauuuuugguggaaaaaaaaaugaaacgaauuccccuaauagaggauuuccaaaauaugugggugauuguugcaacggcguguuccauaauaucaaaauccacugcaacauuugaucuauauauagugaaacaucacgaguacacaaugugcaacauucuaaaugaccuaaugaaacauuaaaacauucauugaaaaaaaaucaucagaauauagucgaguaacauauua

SEQ ID NO: 2272 - RNA, 196 nt, Oryza sativa
uagauuaugaaccucaacaugguaucagagcuggaaguccuaaaguugacaucaugauagccugacgaugguggagaccaugauaagcugauaccauguauuuugccgacauuguguuucuccaagauugugcuacaucacaaacuuagaaaaacuuagaacuucuagcucugauaccauguugaguuuuauggcc

SEQ ID NO: 2273 - RNA, 288 nt, Oryza sativa
uuccucgaaagccaagugacccaauaaguuguugcugccccuacaagaaaaagaugucugagcuauuugguuugucgcaaaguccauugcccaaacauaugugacacaauccuaggcgaacaaauguucgaagaaaucuggauuagagaccaaaccgaccgagcuagccgacaacaagucugagcuccucuccucuccugccaccgcauugcacgccacuccucucccccgccgcucgugcacuccauggccgacaauagccuuguuacggucgccgcugcaggaucc

SEQ ID NO: 2274 - RNA, 68 nt, Oryza sativa
gaccgucgcguuacuacacaguuucgcgagacgagagcugagaagagguggguggugaggggaguuag

SEQ ID NO: 2275 - RNA, 113 nt, Oryza sativa
aaaauagguauaggcaugaaauacauucauaucaaaucucaaguccaaacucaacuucauuugagaaaaacaaaaaagacaaauuugauguacuucaugccuauaccuaucuc

SEQ ID NO: 2276 - RNA, 307 nt, Oryza sativa
agcacggaggugggcuuggaggagauggggaguggaggcggugagacgcgucgucaucgaggaggagcggugcggugaggucggagguugauugcuuggugucauccacuuugucggaugcgguggugcagcagugcgagguccauacgaggaggacuuagccggcguagagggagaggaacgacguggcggcccagacgaugacguuaccggugagcagcacggcgccucccggggagccgccgucgccagccgcaccauccuucgucaccggcauccccaugcccugcgagagcaaagagcgaga

SEQ ID NO: 2277 - RNA, 228 nt, Oryza sativa
aaaaguaaauucaauaaaaccuaaaaguaauuuacauauauuauagaaguaacuuauaacaaaaagaaaauaacuuuaaugaaugccuuuuuuucauaugacacgaagucauauuuuuaucccuacaacgaauuuacuucuaauaucgugacaaaguuacguccguuuaaguuacuuuuauauuauaauauauguaaauuacuuuuaaacuuuauugaauuuacuuuu

SEQ ID NO: 2278 - RNA, 102 nt, Oryza sativa
gauaauucauuuuugcuggcggccgucuuaagccaauugccagcgaaaauggauuuuugcugguggcuggcuuaagacgaccgccagcgaaaaugaauuauc

SEQ ID NO: 2279 - RNA, 291 nt, Oryza sativa
auuauauggauaugccaugucaucauucaugcaaaaucuaugaugaauuacccaauuuacuuuuacguauaucauagaaaaagaauguaagggugaauuagacauaaccauaggaacaaauacuuuucccauuuuuuucacccuuuuacguauauuuuuacucuuacauauaccauauauauauuuuuaacuuuuuuccuuuuuucuaauuuuucuaugauauacguaagaguaaauuagacaaaucauauagauuuuacauaggagggugacauggcauguccauauagu

SEQ ID NO: 2280 - RNA, 141 nt, Oryza sativa
aaaucuguacucccuccguccccaaaaaaaaaaaaaaaaccuaggugaggauuacacaccaccuaggacaacaaauauggacagugguauuaaauccccaccuagauugguuucuuuuugggacggaggggguacauauuu

SEQ ID NO: 2281 - RNA, 301 nt, Oryza sativa
acggccggugggcgaugcucggcgcgcugggcugcaucacgccggaggugcucgagaagugggugcgcgucgacuucaaggagcccgugugguucaaggccggcgcccagaucuucuccgacggcggccucgacuaccucggcaaccccaaccuggugcacgcccagagcauccucgccgugcugggauuccaggucguccucaugggccucgucgagggcuaccgcaucaacggccuccccggcgucggcgacggcaacgaccucuaccccggcggccaguacuucgacccgcucggccu

SEQ ID NO: 2282 - RNA, 97 nt, Oryza sativa
cuaguauuagaaugugacauauucuaauacaacgaaucuagacauagaguauguccagauucauuguacuaggaugugucacgucguaggacgaggu

SEQ ID NO: 2283 - RNA, 311 nt, Oryza sativa
ggugccacugucgguagcggccgacaccgacgccuuugcauccgaucuugaugccggaagcgucucuggccucgaggacggcucagccaagucuggcuucgccgggcucgcuggccggacaucgucgucguacuugacgagccguggccgcuuccucuuuggcgcugcaauaagcaggcaaaagaugagaugaggcucccagaaacccaaaauuggcaaagaagaaaucguugcaaguagggaagugaaagaggcucaaaccuauuguagcaacggaugucgaaucggauggccgugcaaccgaggacgac

SEQ ID NO: 2284 - RNA, 137 nt, Oryza sativa
aaguaucucgaguuacugguaccucacgguaccaaaucauuuccaauuguuagaucuaacaauacacauuaugucuaacuagauuuaaugaucagaaauaauuugguaccgugagguaccgauaccucgagauauuu

SEQ ID NO: 2285 - RNA, 111 nt, Oryza sativa
uacugguaccucacgguaccaaaucauuuccaauuguuagaucuaacaauacacauuaugucuaacuagauuuaaugaucagaaauaauuugguaccgugagguaccgaua

SEQ ID NO: 2286 - RNA, 88 nt, Oryza sativa
uuuuuaacucuacccuaccaaaauuuugauaguaccaagacuuguccaagauuugacacuaucaaaauuuugguagggcaucaaucca

SEQ ID NO: 2287 - RNA, 311 nt, Oryza sativa
cucguaguauuucgcccaaaggguacugugaaggcaccauuauuuuaugggccuggaaguagugcuugagcuugugcgaagccaucaccaagguguaagcaagcuuuuccaucucgauguaucuugucuucgccucuugcagcgcuucggagacaaaauaaacugguuucuggccgaacucuguuucuugaacaagggcggcgcuuacugccgcuggugaggcugcuaaguacagcagcaguucgcuuccuggauucgggcuuaugagggcuggugggcuuugcaaguauuguuuuaggucgucgaacgcu

SEQ ID NO: 2288 - RNA, 179 nt, Oryza sativa
ggugcauacaucuggaaggacagccgauggagggaagagucggaauuuucaguuaaauucagcuagaauuaucaacaaguaucagaagaggcaugauaagcagcaggaaagauauuucaaggaagaugaugguggguuugauccucuuugggacugugacuucuucagauucuguugga

SEQ ID NO: 2289 - RNA, 219 nt, Oryza sativa
cauuaaauuugacuauuugacccuuuuugaaaacuaauuuuacaaaugaaccgcggccaaaacuuauuugaaaaacgacccuuuuguuuagcgccaaaucguaugguuuagcacuguaccauuugguguugaacaaaagagucauuuuugaaauaaguuuuggccacguuucauuugcgaaauuagauuucggaaagggucaaauugucaaauuuugug

SEQ ID NO: 2290 - RNA, 260 nt, Oryza sativa
agagagaucgccggcgcugccgcacggcgcuucuuggcggggguccucucacaccggcugugagguaacgugcuauacugauuccacaucccaucccaaauccauuuccccuuuuauuucuuucuucgcugcucauucugauuccacaucccaaaccacccacaaccuaggguuucuuccuuauuuaaauauuuugauucgucuucccuucuaucgucgcuugugaaacggaggucgccggcgccgccgcaaguugcucc

SEQ ID NO: 2291 - RNA, 270 nt, Oryza sativa
gggagagguaggaggcggcgagcgcggagagggaggcgagcucguccuggagcuccccgucgcggucggcgcggccgucggcgaggcggcggaaguggcgggccuccaagagcgcggcggccuucucccgcugcagccgcucgaucaucagcaucgccucgcucgccgccgucuccgccgcggcgcgcuccgcguccagcucggcgcggaggucccgcuccuccgccucggccgccuccuucuccgcccgcagccgcuccaccgccuccu

SEQ ID NO: 2292 - RNA, 252 nt, Oryza sativa
ccuuugaauuuuacucccuccguccuagaauauagagaguuuuuagaguuggacacgguuauuaaaaaaguagguagaauuaaauaggaagggguugugauugguugagaaguggagguaggugggaaaaaugaaugguggaggguugugauugauugggaagagaauguuggugaaguuguuauauuuugggacaaauccgaagugcuaaaaguugguauauuuugggacggggggaguaacuguuauaga

SEQ ID NO: 2293 - RNA, 140 nt, Oryza sativa
uugcuauuguugcaugcaacgcuucugcacgguuugaugcucuuagucaaaguuauagacaauaucaacuacaaucgcaucuccugcuacagcaacaagugcucagcccaugcagugaguucguaaggcaacagcauagc

SEQ ID NO: 2294 - RNA, 270 nt, Oryza sativa
ccuuugacugaugucgucggaacgcucgcggaucaucagguggcggcaucucugaaggagaaagucgucaaggaggcgucugacgcugccaccaccagugguggcgaagcuccgaccaaggcgaggaaguucucgucugugcucagacaucgccgcaaagcagcgacucccucgguaauuucaccuugucgcuagguuauguagcaaggaagguuuauucucauacuacauugguugucuugcaggcuuccgacgcgucuccuccaccuc

SEQ ID NO: 2295 - RNA, 130 nt, Oryza sativa
augcaaugacugucacaacgagguuaggccucagguggcaaaggaguggggaggccgccauggagugccaagggugugacaucccuauggaugcuaccguggaugagcuguuggauaggaagauggcgag

SEQ ID NO: 2296 - RNA, 71 nt, Oryza sativa
ugcgggucacuuaacaggcccgcacgcaaaaauagguuauuuucgcgugcgggccuccuaauccaccagcg

SEQ ID NO: 2297 - RNA, 275 nt, Oryza sativa
gggagcggcgacgccaccaccgccgccgacgaggcuagagcggcggcgacgacccaaucuaggguuuucuguuuuuuuuugaaaucuuaauuuuuuuuugguuuuuuguuuuuccgugcgggcggcauaagccaccggcaagagaaaaucgugauuuucccaagcgauuuguuccagacgggccgaggcuccgcaugcaaaaauccgaucgaccgcacgaaaaaacgcuuuguguaguaguguaugcguggugugugugugucaagugcuaagca

SEQ ID NO: 2298 - RNA, 311 nt, Oryza sativa
aaauauuucaugaggugauuugauuguguuucaguuuuuuaaaagauugaaacuuuuuuaucuacuuggugaaacauuuucgaucuacuugugaaacaaagcucgguuggcuucaaaaucuauacgauggaagccuaaaaaaucauguaaaucccauauagacuuuuucucgaugugcauggauuuguuucauguuucaauauauucggaaccguuguuucauacauuguagcaaaauauuuuauuuggugauuugauuguguuccaacuuuuuuaaaagauuaaaauauuuuugauuuacuugggaaaac

SEQ ID NO: 2299 - RNA, 228 nt, Oryza sativa
gcuccauggauccauucuuuugauucuuucguuucgcuuucuugcuguccucuugagagagaggccgaacgcucccgggucuugugcgagugggugguggcagcagcccagcauacuacaagcguugcagugguugggaggaggaugauaugauggcguuugcaguuugcacgcauuugaugcuuugauagugugggcggaggaggaggaggagaugauggauggcgc

SEQ ID NO: 2300 - RNA, 111 nt, Oryza sativa
aauagcaacuuaggaccggaugagauguauccuaguacuacgaauuuaggcagagggcauguccagauucguacuacuaagauaugucucaucuaguucuagguugcuaua

SEQ ID NO: 2301 - RNA, 240 nt, Oryza sativa
cacugccacauaucccuggguauuaugguccuaaaguuucacaaaaucacacuguuaaccauuuugacauacuccuauauaaaaaaaaaacggauguaacauuuauaugguggauacaaugcucaaaaauuuaagaugugacuguagaacuaaaaaaguaugguagaacaaagucaaaaugagaaguaacguaguuuuaugaaacguuuggaccauaacaccuaggguuaugugguuaug

SEQ ID NO: 2302 - RNA, 148 nt, Oryza sativa
gaaaguaaauucaauaaaaccuaaaaguaauuuacauauauuauagaaguaacuuagaucaaaacgaagguaacuuuaauuaaugccuuuuuucauugaacaaauuaucauauauauaaguuacuuuuagauuuuauuaaaaauacuu

SEQ ID NO: 2303 - RNA, 303 nt, Oryza sativa
aaagacauucuaaaaaacugguaauuugcuagaugacacuuucggcucaaucgaagagauggauuccuaaaaaaagaugagaaugccccucuggccacaugcuuaaaaauuuggaaauuaugcaacucuaaauuugccauagcccaaaguacaucacuagcauacaccauauuucauuuuuacucuagucucgguuuaaaaagcuuuugguccuagggucauucuugucuuuuugaaaaauuucucuuuccaauugagccagaaguguccuccagcaaauuacuauuuuuuuaaguuucuuuu

SEQ ID NO: 2304 - RNA, 79 nt, Oryza sativa
uauucgcauauugcuucuuuucgauagauucggagauuccggagaguaacgagucauaucccgaggaggauagugacua

SEQ ID NO: 2305 - RNA, 122 nt, Oryza sativa
caaaauuagcugggagcagccgccgcgcaagguugucgacggcgagucagcggcggcgcggagcgugugcaggaggcggccacgcgcgaggccugugacggcggcugccacggcggcgcgga

SEQ ID NO: 2306 - RNA, 76 nt, Oryza sativa; identical to SEQ ID NO: 2016

SEQ ID NO: 2307 - RNA, 290 nt, Oryza sativa
auccggccuccccgcgagccgcugcccgcaggcgcccgagagccgcgccuacugucgccgccgcgugcccaccucgcgucgucaucgccacgccgaaaccgccgccgccuacuguggggugggaggaggagagagugcugguggggguagagaagaggagaggcugguuggugaggauggauggcgacgguggagaagagagggaggagaguugcgagggagagaagggagggaggggagcuggagagagggggcgggugggugguggacugguggugguggugguggug

SEQ ID NO: 2308 - RNA, 207 nt, Oryza sativa
aaauauuugacgccguuaacuuuucuaaacauguuugaccguucgucuuauucaaaaacuuuuuugaaauauguaaaacuauauguauauauaaaaguauauuuaacaaugaaucaaaugauaggaaaagaauucauaauuucuuaaauuuuuugaauaaaacgaacgcucaaacauuuuaaaaaaagucaauggcgucaaauauuu

SEQ ID NO: 2309 - RNA, 132 nt, Oryza sativa
cgaacaccuuccccgucgacgucguggcgcgcaggugguagucgacgucggccaccuuccccuuguccaccgacgcgccccacgcgaugguggaguagcugagcgacaugacggcggcggcgagggacacgc

SEQ ID NO: 2310 - RNA, 98 nt, Oryza sativa
cggagacagaggagagagaaagagagagagagagagaggagaagccguaagccuagccgccuccuccuccuccucucucgccgcccuacgccuccccc

SEQ ID NO: 2311 - RNA, 85 nt, Oryza sativa
uacugucgaucucgcacaaccguugcacgacgauggcugcgagaccgcguggugucgugcggcgaggcugcgagaccgagcgguc

SEQ ID NO: 2312 - RNA, 121 nt, Oryza sativa
uucguccacgucaucacgaguuaaaauuuaacucguaggagcaaaaauuuuacugggaguaaaauuucaggaguuaaaauuuuacuggaguuaaauuuuaacucauggugacgugaacgaa

SEQ ID NO: 2313 - RNA, 266 nt, Oryza sativa
uuuccaaauuaugugagugguuuguugcaacgacgcguucuauaauaucaaaauccacugcaacauuugauccguauauugugaaacaucacgaguacacuaguugaaacaucguaaaacuacugguugaaacaucuaaagaaccaaaugcagcauucuaaaaaaauaucaauaaaaaagcuaaaauauuauuuuaucgaaauauaauuauguguggucuuguuauaaagauuuaauugaacgaauacaacggcgugaucggaucg

SEQ ID NO: 2314 - RNA, 97 nt, Oryza sativa
gcaucuucuuuuggcgcuuugaugacugcgaagggggaucagaucuugugauaacuuggaucacccuucguuguacauccuagcgcugcucagccgg

SEQ ID NO: 2315 - RNA, 269 nt, Oryza sativa
aaauacuccauccauuucaaaauauaaggcacaaccacccauaacccaaagaccaacaaauaauuauucucaucuuguuguucggaucauccuaauaaauauaaugcaugcauccaauagaauuagauaacaugagaguagaugauuuaaaaaaguaguaauuuaauagagaagaugucacaguuaauuguaugcuuguacaugccuuauauuauggaacaucuaagaaaagugauugugucuuauauuauggaauggagggaguauau

SEQ ID NO: 2316 - RNA, 81 nt, Oryza sativa
ugccgccucgucgccgcucagccuagacgacggcagccucggcgcggaguugcgacggcgucagacggugaugaggaggca

SEQ ID NO: 2317 - RNA, 164 nt, Oryza sativa
caaaccauauaaugcaaagaaacacaaaucaacacuugagcagcacuugaugaugaagaugaggcugaggaggaggaugaggcugaagaugaggcugaggaggaugaugaugugauguacugcugaagugcugauuuguguuucuuugcauuacauaguuugga

SEQ ID NO: 2318 - RNA, 314 nt, Oryza sativa
accgaaagaggcguuuacccuuggauuggauggaaguuagugggaccggguuuaugguaggaaauaaugauuuuuggaauuagugauuuaccuuuuuaccccugugaaagaguuaacccuuccaggcuaucgcuccucuccucucgcugcauaguuaaaccuuccagauuauguugucaugcuuugugauacuugugagguacaauaugacuucauaugauuguguaaaauuuuguugaaauuuuguuaaaaugcugccgaaauuuuguuaaaauuccauuaaauucaaauuuuguccaauuuguaaugucaaa

SEQ ID NO: 2319 - RNA, 261 nt, Oryza sativa
cuaacccgcuccaugcgcugacgugacauugccacaguggugccuacgucucaguggaauccacaugugaagcauauauaaaaaauaaaauuaaaagccauauuuucuccucuuaagguagacaaaaaaagauaaaaauucuaauguagaggagaaaauauguuuuuuaaucuuauuuuuuuccuaugugaaugacacguggguccgacuaacacguagaugcuaucguggcaugccacaucaacgcauggagcgguuugg

SEQ ID NO: 2320 - RNA, 111 nt, Oryza sativa
ucaaaucuaauaccggaugugacauauuuuaguacuacaaaucuagacagauguauguuuaaauucguacuaguaauuaauaggauguguuacauucgauacuaggggugu

SEQ ID NO: 2321 - RNA, 251 nt, Oryza sativa
cuccugcuggucaccgugaccguuugcuuccaccguagcuccugagggcgggaguggcggauccgcccaccggcguugcuccgauggacaagggcaacggauccgcccgccagcugucguggccgcucgcucccgaggauggggguggcgccucgaucugugcacggcggaucuaccagccggucgcuguggccgcucgcuccugccgucacuguuccuuagguugggagcaguggauccgcacgccagcg

SEQ ID NO: 2322 - RNA, 193 nt, Oryza sativa
auuauagcucucgacgugaccuacaacuuuguaguugaugaguuuuugaauuaaaacuguuuagggucccaaaauauuguugcauguuuauagauuuugaaauuuuaauuuuaaaauuacauuuugggacaaaaaaugacuuaaaauaaaaaaaaucaacuauaaaguuguagaucgcgucgagggcuacaag

SEQ ID NO: 2323 - RNA, 121 nt, Oryza sativa
uuucuuaaaauuggaugcuugucaaugguaugucuuggauuuucucauucgguaaugaugaaaaauagcgauaguaaauucauauuaggauauauuuauuguacuaguuauaguauuuuac

SEQ ID NO: 2324 - RNA, 107 nt, Oryza sativa
cuuuuagagaugagcugaugauggacaaacacauuccauuccuccaaacaaauaacauauuuagaaccaugucaucaauuguccaucuuauuccucaaaccacacaa

SEQ ID NO: 2325 - RNA, 70 nt, Oryza sativa
cuccauggaggguggugagggcagucagaguggccugacuugaacugcccuacuaccccagcaaauuuug

SEQ ID NO: 2326 - RNA, 309 nt, Oryza sativa
gccgagcauguggccgcugcacgugauggcacgcaccgagugucgcguggccgaccuggucgcagccgccauggagcucuacgucuaggaggagcgcuggcugcugcugcuguccgccgaccccgucgccuucggacuccgcuucuucuucucccccaaggcugcagcgaccgccgcaaucaccgccgcugccgcuccucccccgccgauuuagggaugagagaggaagagaggaagagaggaagagagggaagggaagaaggggcugacaugugggacccacgcugagucaguugccacguuggacaa

SEQ ID NO: 2327 - RNA, 311 nt, Oryza sativa
acgacgauccggagcuugcucccggcguugaugccguuccucucccugaucgccgccagcgcgguuaucuccugcuucagguuccagucgaacauguggucguagaacugccacaagaagcguucaucaggacacguguacgguggagguuaaucaggacaugguauauaauacuauaaugcaugguuugcuuacgaugcaggggacuccggggugggugaggauguaggcguagcccugcaugaccuugucggaggggaacggccaaagcuucugcgucgagccggugucgugguugucgacgaacguga

SEQ ID NO: 2328 - RNA, 141 nt, Oryza sativa
cggcauauacuuaaaauagaguguguagauggagagacuguuggaacgaggaacauguuuggcucuccaaaucaguuggagaggugacuauggguauuuggagagucuaauuuggccauucuauuggagaugcucuaacaa

SEQ ID NO: 2329 - RNA, 224 nt, Oryza sativa
cccgagccuggcggacagguuccggagcagguucaggccggcgagguucgggcggcggcgaggcgggggcgcgggcgcggccgacugccgcgucugccucgcgcgguucgagccggagucgguggugaaccgccuccccugcggccaccucuuccaccgcgccugccucgagaaguggcucgacuacgaccacgccaccugcccgcucugccgccaccgccucc

SEQ ID NO: 2330 - RNA, 311 nt, Oryza sativa
uaucugacuuuguagcuucaagguauaucucgauaaaugaaaugggaauaacuacugccguucaaggaacaauuagcuacuuggaucucauguacuauuauacuggaugacuuacgaguaagagugauguuuuuagcuuugguguucuucuuauggaguuacuuacucggaagaaaccaauuggugguacauuugauaauggcgauggucuuguuucacauuucgucucacuugucucaaaagguaaccuuuaugacauaauagauucucaaguuagggaagaggaagauggagaaguccaggaaguagca

SEQ ID NO: 2331 - RNA, 155 nt, Oryza sativa
agauacucccuccgucccaaaaaaaacccaaccuaggaugggaugggacacauucuaguacaauguaucuggacauaugucuguccacauacguuguacuagaauaucucccaucccauccuagguuggguuuuuuuuggauggagggaguacuu

SEQ ID NO: 2332 - RNA, 67 nt, Oryza sativa
ucgcaauuaagaugggacgagcugcuuacgccgucuucggcuggcugcuuggucaucuuggcgaaca

SEQ ID NO: 2333 - RNA, 311 nt, Oryza sativa
gguuuaaagccaaauauuugguaaugccuauacucaauuuggcacaauucuagaauguucuucaccauaauuugaaauuuggcucucaauuggcaucaauccaaagacacucauuuacaauucuacccuaccaaaauauugguagugccaaagcuugccuagaguuuggcacuaccaauauauugguaggguacuaaaccaaacaagcccuuaauaccaauauaaagccaaaauuuaguaugagagugaagaagauucuaaaauguagccaaauugagcgugggcacuaccaauuguuuggcuucaaucua

SEQ ID NO: 2334 - RNA, 64 nt, Oryza sativa
accuaggagggggacaaugaaucuggacuacccuuuguccagauucguuguccuuaaacuagga

SEQ ID NO: 2335 - RNA, 60 nt, Oryza sativa
uucaucuucuucucccucaaaggucuccaagaggaggacuuugaggcagaggaagaggau

SEQ ID NO: 2336 - RNA, 76 nt, Oryza sativa
aucuauacuauccaaaauuugguagugccaaaauuugucuaaggcuuggugcuaccaauauuuugguaggguuuca

SEQ ID NO: 2337 - RNA, 194 nt, Oryza sativa
guagucgucgucacugagaucauccauguccggcaacgaaucgguguagaugaaaugcaggaggccccugaaaacaucagguugcaugucuuccacgguuacccgccgggcccucuucuccuucaucugcccauagagcuccgccuugaagacggaugaccgugcugcaaggaugaucuugugagcggcgauuu

SEQ ID NO: 2338 - RNA, 98 nt, Oryza sativa
auuagaggcgagagagggcacaagauaaccaucuaggacaugcaacauguuguguauguguccuggaugguuaucucaugcccucucucgcgccucau

SEQ ID NO: 2339 - RNA, 281 nt, Oryza sativa
ucgauccacgucucugguggcugcuccggaugcugcgcuacacgcccccuccgggcccgagaggcgccggcggcagcggauccaccgcucccgcgccuggcagcgauggagacggaugccgacacggcaagcggcgaagggggaggaagccggugcggugagcggcgcccggcggcggcggagacggaggccggcgcccagcagcggcggagacagaggccggcggucucaucugcaguagcgccucgcgugugguggcggcuuaucugauuuggaucggc

SEQ ID NO: 2340 - RNA, 203 nt, Oryza sativa
cuauugaaaguuccugguacacuuuaauaccauuggaagauugcaccauuuaaguuucuuuuuuuuuguuacugugguuuuuugcaugaaaaaaaagaaagaacagguaaugcuaaacaguaauagauaaguggaugggaugguaaccaacuauguuguguuaucuuucggugguauuaaaguguaucagaagcuuuuagugu

SEQ ID NO: 2341 - RNA, 285 nt, Oryza sativa
guuucuuuggccuauccuuugauuugucucgauucggacaccggguuuucuuauggccugguugauggcauauggaacaucuauuuugauuggauggcucggaaguauuguuugccuuuacuaaccgucauuugccugcaccuuuauacccuuuauccaugucguuuuuuaaucucuuuguccuucgucuuccucgaaugucguucuucaacgacaagucgggaaugaauaauucaccaucguaacuuggccacugagauggaucuagguaaggcucaaaccucg

SEQ ID NO: 2342 - RNA, 294 nt, Oryza sativa
augaccacguuccgccucagguacggcaagaacggcgagcucgccaucacggaucgccgcccgagccgcuccuauauucucuccagauaugucagauuuucgugugcaugcauucuggauguauuuuuuuuuugggaaauuuugcuacaggacaucgcgauuauguguauuuagcucagggacaccgcgaaagugaagcuuuggggaaagacaucccauaaucgugguuauuuguugaugaacaccgcgccgucuagcguagacuugccgugcugacguggcugacgggaggcu

SEQ ID NO: 2343 - RNA, 63 nt, Oryza sativa
uguagcgcccuagcaccgugcagccgugcgccgccgucgccgcugcagcucuagccgugcgcc

SEQ ID NO: 2344 - RNA, 120 nt, Oryza sativa
ucuuagucuuucugugauuugauuuguguuugauuucucccuguaaaaauauauuuacgucagaaugguagauagcugccuuuauuaacaucgaguccauucuaugcagaggcugcacaa

SEQ ID NO: 2345 - RNA, 72 nt, Oryza sativa
ccuccgcaggucacgcccaaaguaccuagauccugacuguuucagguccuucguggcgguggcagcggcgcu

SEQ ID NO: 2346 - RNA, 112 nt, Oryza sativa
gaggcgucggucggaccauugucgggucggcgaucagaccggccugauggcccggucagaccagccguauggcugcggccgacugcgaugagcugguaccggcuucggauuu

SEQ ID NO: 2347 - RNA, 78 nt, Oryza sativa
cuuuguccggaucggcuuuuacuugguucucuucuuugucguaugguucgaucaacaguugggccgauuuggagaagc

SEQ ID NO: 2348 - RNA, 100 nt, Oryza sativa
acuauguuugcacuguuuggaacuguucacauguugguucccggcaguaaaacugcuggaacuaacaugugaacagugucaaacagugucaaauaguguu

SEQ ID NO: 2349 - RNA, 73 nt, Oryza sativa
ucuaccgcgguggcguguuuuggagccgugggaccacgauggucccguguuuuggagcugccggaccgucgcg

SEQ ID NO: 2350 - RNA, 263 nt, Oryza sativa
gugcauuucuguauuauugcuagcucucccacccucucucccagauacggcucuuccauccacaccucauccuuccuugauuuguuuagugacaguggcaaagggaguggcggcggaggccaguggcggggcggcuaacaguagcaaaggggagggugacgaggucuagauccaacaucccucagcgaugccaaagauggaggugaggauggcggcuccaucuagauccggcguggcuuggcgauagcaacauggauacgaag

SEQ ID NO: 2351 - RNA, 154 nt, Oryza sativa
gauauucaacaggcuaaguacgauaggcauccaucccacaugacauucuaaaacaauaaauuuaauagaaagcgguggauuuuguaaaaauagguucaacgugaucaauguuguauguaugacuugccuugcucuugagcugacgaaaccucgg

SEQ ID NO: 2352 - RNA, 62 nt, Oryza sativa
gcgggcggcauaagcagccgcacgcgaaaaucggauuuucgcgugcgguugcgccacccgca

SEQ ID NO: 2353 - RNA, 184 nt, Oryza sativa
ucgugcucgcugucgucgcuaucgucggguccguccgcucccgucgcuggagccggauccagcgcccccaugccuccccaccgccgcaucugccacccccgugccuucccaccguccgaucugccaccgcuacgugggggcagggcagccgucaucggauccgcgcgggcgauagccaccgugc

SEQ ID NO: 2354 - RNA, 167 nt, Oryza sativa
ugauauaucacucuacaaacaugcaaguugaaauucaacuucuacaucucacaaccgagaaaaauaaauuaaacuacaacuaguuaacgaauauucacagucaauuuuuuucguugcaagauguagaaauugauuuugaacuuguauguuuguggaguuauauauca

SEQ ID NO: 2355 - RNA, 161 nt, Oryza sativa
uccuuggacuucucggagucaaaccgcuuguuauugucaguaaugaacucuuucggcacaccgaaucagcagaaaauguuuuucugaauggauuuuuacacuugugcugaagguacugccuuagcccaucgaaggcggcuugacacucagguguccaauug

SEQ ID NO: 2356 - RNA, 305 nt, Oryza sativa
cccuauaguauccuacgugacgcugauguggcaugccacacgaacaagacguggcauuauuuugacuaauaaaugaaacccauuuaaaaauuuucuuuuuuuucuucuuuucuuaucuuuuucuccuucucuuuuuuuuuccuuucuucuccuuucucuaugacccgaauagaagaaaggaaaaaaagaagaaugagaagaaaacaaaaaagaaaaagaagaaaaaggaaggaaaaagaaagaagaaaauggcacgucacguccauauggcaugcuacaucagcgccacauaggauccuauaggg

SEQ ID NO: 2357 - RNA, 291 nt, Oryza sativa
uuagucccuguuauaucggauguuugaacauuaauuagaaguauuaaacguaaauuauugacaaaauccauuucauaauucuggacuuauuugcgagacuaauuuauugagccuaauuaauccaugauuagccuaugugaugcuaaacaugugcuaauuauggauuaauuaggcuuaaaaauuaaaauuuaucacgugaauuagcauuuauuuauauaauuaauuuuuguaaguaguuuauguuuaauacucaaaauuaauguccaaaacaucugaugugauagggauuaa

SEQ ID NO: 2358 - RNA, 254 nt, Oryza sativa
uugauacuaccuccgcccccaaaauaauuguaauucuagguuguuuagcauauauuaagguuuaagaagaaagacuaugauaccccuuauuaaaugguauauagguaagagugggaggguaguugaagguaaaauagagagaaauuugaauaagaaaugauuaaugagaccauuaguauucuguugugauaacuauuuuuggacaaauucaaauccuauaaauacaauuauuaugggacagaggcaguaauaau

SEQ ID NO: 2359 - RNA, 204 nt, Oryza sativa
cucuccccgccuccuccuccgccucaccgccgccaaagccgcgcggcugcaaggacggcggcggcagggccucaucucgcccacgcugcgcucggaggccgggggagcuguccguggcggcugcggugguggccagauccgugcuguguccggcuagaucugccagggagguggccggguggcgggggcugacggugguggugg

SEQ ID NO: 2360 - RNA, 259 nt, Oryza sativa
gcuaaaguuuuguuucuaugauugccagcuggguuugucugcaaccuuucuucauggaagugcuaggaauuggauguuggaauaucucgaauagaagaaaugaucucauauucaauaaugugcccaucaaccuuaguaaauggaaauccgacuucagagaggauuuuacucggcauaugcacagaguaaaaguugcagacacuugaguaaauaauggcauaaagacaaucggcugaugauaauguaauaaaacaauaau

SEQ ID NO: 2361 - RNA, 179 nt, Oryza sativa
agggagcuuuugauucugggagaagcugcagcaguuagaagcuuauccaaauaugcccuaaguagguacuauuugcacaauaagccauggaaaaauaaagaaagcaauggguaacaaaggguuuuuuuauccguguuauucuagguuuaaaagcuucguuucaaaauuaugggcuuaua

SEQ ID NO: 2362 - RNA, 68 nt, Oryza sativa
uuuggugcaguaacaaguauaugguuaguauuugagacuuuuaaccuauauauuuuugcuguaauuca

SEQ ID NO: 2363 - RNA, 144 nt, Oryza sativa
auugcuuauuugaccccguuuugagcccuaacuacuaauuugacccuacuuuuuaaaguuugcuuauuugacccuccuuuucaaaaagaagcucgcguaugacccuguucuguuaagggcaucuaacgguguuaacuaaagcac

SEQ ID NO: 2364 - RNA, 109 nt, Oryza sativa
auugacccagucacgcacacgauaugaugcuucuaccccucacaaguacaaauagaaugcaugacaaugagggguagaaacgucauauccuguguguggcuuggucaau

SEQ ID NO: 2365 - RNA, 92 nt, Oryza sativa
uauuauaaccuacgacugaaugagauguacugauguaucauaguacuacgaauuugaacaugauauaucucauccgguuuuagguugcuaua

SEQ ID NO: 2366 - RNA, 84 nt, Oryza sativa
ucuuuaguucuuuacauguauaaaauucugaggauguuauauauaugacauccucaggauuuuauacauguaaagaauuaaaca

SEQ ID NO: 2367 - RNA, 94 nt, Oryza sativa
agcagaucaggugguggacugguggugguguuuuuuuuucuuuuuucuuuuuuuuagcaggaagcgcgacggucgauuucauuaagauuuuggg

SEQ ID NO: 2368 - RNA, 198 nt, Oryza sativa
agaagaaaaccuuuaugcauucaagcuacggagagauucuauucaacaaauugugcaucuugucgacacaaauauaaaauaaguauaaauuagaaauacacaaucauucaacaagaagcgcccuuauagcucagugguagagcgucagucuuguaaacugaagguccguaguucgauccugcgugggggcauuuuuua

SEQ ID NO: 2369 - RNA, 244 nt, Oryza sativa
uuacaacuaccuccaucacauuauaagugcaaccaugaguuuuuaugccuaacuuuguucuuuugucuuauuugaaauuuuuuuauaauuaguauuuuuauuguuaugagaugauaaaacaugaguagcacuuuacacgugacuuauguuuuaaauuuuuuuauuuuuuuuaaauaaggcggacgaucaaaguugugcacggaaaaucauggcugcacuuaaaaugggacugaggaaguauuaa

SEQ ID NO: 2370 - RNA, 311 nt, Oryza sativa
cucucucgagcugcaaaacgguacugcuagugcuauaguuaaacagccucagcccuuguucaacacauggaggucauguaaugucaugcagugcaauacauuaagccagcagcaggaggucccuaguuugccucaaauacagauaggauuaccuaacgucauguucuuaacgucuccaauaccagcaggccuacuugccauagaugcacaugcccaccucguagcucaccaagagcauuauugcugaaaagaagaagaggcagaagccaccacgcaguacugcgguuauuguguugcagccaaaguguaca

SEQ ID NO: 2371 - RNA, 153 nt, Oryza sativa
auaucaaggaacuacgcaaagauguuuucaaaaaggauuacauaaaauuugagaagaaacauggagaggcuuuggaugauuaccuugcaugcuuugacaaaguuuugaguaaucuuagauuuguugauacaucuuaugauacuucuacucaca

SEQ ID NO: 2372 - RNA, 304 nt, Oryza sativa
aaucauuugcuuuagauguggacccuguuuuacuauauacaaauugcaagagcuaguaauaauuauaauuugguuucguauaucucaccuuauuacccacuugaugaauagaguauauauugaggauacucuaaagaauugccacagauaccugcagauacaugugguguuugaaacucauguagaugugguguuugaaacucauguagaugaagauuaaguguuuugcguaaaauuauuacaaacuugaaaaauauauuuaucugauauuuuagagcagcuuuuauauaaaaaaauuucguau

SEQ ID NO: 2373 - RNA, 210 nt, Oryza sativa
ggaucccauauaucugguuuugcgauugggggauaauuuuguaauccgaugacaagaugagggaccuuagauguacuuuuuccggcccaaguauaauucuuccucuccuguugauguuucucaaaaagaaauaagucuauuuuaacucccucaucucguacccuugaucaaucccaucccccaaaccgcaaaaccagguauaacaccucc

SEQ ID NO: 2374 - RNA, 106 nt, Oryza sativa
cucaacuuuauuugggaguaacaaaaaagacaaauuuugaaugaauauuaacaggacacuauuuaucugaaauuugucauuuuuguuucucucaaauaaaguugag

SEQ ID NO: 2375 - RNA, 252 nt, Oryza sativa
ucgauccacgucgccgguggcugcuccggaugcugcgcugcacgcccccaccgggcccgagaggcgccggcggcagcggauccacagcucucgcguccggcagcgguggagacggaugccggcacggcaagcggcgaagggggaggaagccggcgcggugagcggcgcccggcggcggcggagacggaggccggcggucucaucugcaguagcgccucgcgugugguggcggcuuaucugauuuggaucggc

SEQ ID NO: 2376 - RNA, 311 nt, Oryza sativa
auggugcgcaaccauaguagaaauuagacccaacucccaagcagauuuucugugaccaaacaauauuguugggauguguguguguauuuuucccauuuuucugugggggaccagggcugucuaugugugccuggucaagaguuagcucauauauuggacuaaauaguaaaaaguauauaugaucuaaugguguagauugauuuaauuuuuuauuuaauuagauugcaauauaaaguuugaaaggguaauuuugucuuuucuugguuauucuauaaucaaaucgugcuaucgucacgugcuuugucaucaaa

SEQ ID NO: 2377 - RNA, 302 nt, Oryza sativa
gugacugugacuagaguaugacaccauguguuuugcuuuuggcaugacuggaccggagugugguuguuucuguuagugaucucgugaugacaaaaacuuguguaugcuauuguuuccaugacugaaacuguaaguggagugguugcugcaguuggugaacaugcgaugauuggaaguugccaucugcuauuuccuugacuagaaugauuuugauggauguauguuugguauuacugauuggugaccuggugaucuguuggacuuguaagacuuugguggacguauuuuguugugauucauuu

SEQ ID NO: 2378 - RNA, 70 nt, Oryza sativa
accguacuuccacaugucuaguggguaaggcguacuucguggcucagucuggucaugggcaaaaguacac

SEQ ID NO: 2379 - RNA, 75 nt, Oryza sativa
acugacuccucuuuucuccaggggcuugucacuuggaauugcauugacaguuuauggcagggaagaggaagcuga

SEQ ID NO: 2380 - RNA, 77 nt, Oryza sativa; identical to SEQ ID NO: 1948

SEQ ID NO: 2381 - RNA, 188 nt, Oryza sativa
cggccgaccgugccccaucgacaccggcgccgccucguggccgaccaccgccgggaaccguuccgcagccgccaccccaucguuacggcagacggggaggaggacgagcaccauguugagcuucagcgucucggcgaugcccuggucggccacgaggcggcgccggcgucgauggggcggucgcagcc

SEQ ID NO: 2382 - RNA, 253 nt, Oryza sativa
gguagacaugucacgaggugacauagcauagaucucaacccuccaaaauaaauccaacgguugagauucguucacgucaucacgaguuaaaauuuaacucguaggaguaaaaaauuuacugggaguaaaauuucaggaguuaaaauuuuacuagaguuaaauuuuaaaucgugaugacguggacgaaucucagccguuagauuuguuuuggaggucugagaucuacgcuaugucaccuugugacaugucuacc

SEQ ID NO: 2383 - RNA, 121 nt, Oryza sativa
uucguucacgucaucacgaguuaaaauuuaacucguaggaguaaaaaauuuacugggaguaaaauuucaggaguuaaaauuuuacuagaguuaaauuuuaaaucgugaugacguggacgaa

SEQ ID NO: 2384 - RNA, 141 nt, Oryza sativa
uagagaugucucacgaaccccuuccagugucuaaccgaucagacaauugguuuaggguucagggagagauucggcgucacaucugcgucuccuccuauuucucauauauaucgacacugguggggcucggggguuuaucuc

SEQ ID NO: 2385 - RNA, 114 nt, Oryza sativa
gaaggccucaugccauaucgccaacaaucccccauacuugaauuaccaaauuuggucguuaacaaguauauaucaauauaugggugguuucgcugauguggcauccuagucaau

SEQ ID NO: 2386 - RNA, 303 nt, Oryza sativa
gaaacgacaaguacauguguuguccauguagcgauugcaggaaugagauuuugugggaagaugaaaaguaaguacacgcucacuugauacgccggggauucauggagagauacacauguugggugaugcauggagagcaagaucuggguacugauggugcagcugcagacggaagugguacagacauucaugaagaaggagaugaagaagagcaugacauguuugucccaucuccauugggcggugaaaugguugauguggacccugauaugcugcaagauauguuacgugacguugaugacc

SEQ ID NO: 2387 - RNA, 103 nt, Oryza sativa
uuguacuacaucaaagagugcuuacugcagggaccaugcucauacgcauuggccauguaacugaauaugcuccuugugcuuggacacuuucgaagauaccgau

SEQ ID NO: 2388 - RNA, 64 nt, Oryza sativa
aguuuauuugauuugcccagauuuuuuucuguguacaggaugaccuuuggcaaucaguucuuac

SEQ ID NO: 2389 - RNA, 141 nt, Oryza sativa
ugaagaugccuaucaacgguggugugaccaaucaaccauauagaugaagacaccagucggcagcagaugagacaacuggucggugaugaugaagaugcccaucaacggugguaugaccaaccaaccguguaggcaagaaca

SEQ ID NO: 2390 - RNA, 304 nt, Oryza sativa
caugugccuuuccaucaacccuccucgcccaguguggccucagcauagacgagaucacuucccgaguuucuaagaacacaaacuucugcauuuuucccuuauagcaaaugaagcaauaugaugauagaagaaaugaaaugcuuagacuucuaauaaaguucaagcauuucauuucuucuaucaccauauugcuucauuuguuauaauggaaaaaugcagaaguuuguguucuuagaaacuccggaagcgaucucgucuaugcugaggccacacugggcaaggaggguugauggaauggcacagg

SEQ ID NO: 2391 - RNA, 83 nt, Oryza sativa
acugaauaggauauuucauaguacaacgaauccagacaggaggaugucuaaauucauugugcuaugaaauaucauauccgaua

SEQ ID NO: 2392 - RNA, 236 nt, Oryza sativa
aaaaguaaauucaauaaaaccuaaaaguaauuacauauauuauagaaguaacuuaaaacaaagagaaaguaacuugucacgacauuagaaguaaauccaucguguaguagauagacuuauguuuuuacccccacaauagauuuacuuuuaaugucguaacaaguuacuuuacuuuuguuuuaaguuacuucuauaauauauguaaauuacuuucagacuuuauugaauuuacuuuu

SEQ ID NO: 2393 - RNA, 169 nt, Oryza sativa
ugauaugucaucuaccgacauauaaguuuaaauucaaccaauacaauuaggaaaaaaaacaacaaauuaaacuaaaaauaacauauucuauuuaaagucaauuucguuauuuucgucucuucucauauaaguugaacaugaauuuguaugcucgugcaauguuauauca

SEQ ID NO: 2394 - RNA, 230 nt, Oryza sativa
agccuccuccuccuccgcgcugccuuuggaucuccgcgcuuagccuccgcgccgccgcaggaccuccgcacccagccucagcgcugccgccggauauccgccgcguugcugucgcggcugccaccgccgccgcugccgaaugucgccgccgaaguccccgcgcgccaccggccgaagggggaaaaggggagagaaagagagagaagggagugagggaggaggaaggagga

SEQ ID NO: 2395 - RNA, 81 nt, Oryza sativa
ucacaggcucuaucuugugguaugaacugaguacacggugauuauggugaguauuggggucuuaccauaagucaaggucgu

SEQ ID NO: 2396 - RNA, 143 nt, Oryza sativa
aaaaaauaccucgagguacugguaucuuacgguaccaaaucguuuccgaccauuggaucuagcuaaauaggauggacauuguuagaucuaacgaccggaaacgauuugauaccgugagguaccgauaccucgaggaauuuuuu

SEQ ID NO: 2397 - RNA, 137 nt, Oryza sativa
aaauaccucgagguacugguaucuuacgguaccaaaucguuuccgaccauuggaucuagcuaaauaggauggacauuguuagaucuaacgaccggaaacgauuugauaccgugagguaccgauaccucgaggaauuu

SEQ ID NO: 2398 - RNA, 100 nt, Oryza sativa
agauccauuaucgcauacggcugcuuaagacagccgcaugcgauaauaggucuauuuucgcaugcggcuguccuaagcagccgcaugcgauaauggaucu

SEQ ID NO: 2399 - RNA, 246 nt, Oryza sativa
gucaaacgcaugccgugguuaucagagacagcaaccgccguccaccgucuguugccgccccgugcgccgcgccggccaccaacucgcuggccacauuugauacagagagagauugagaggaagagggaaagauugagagauuaagaggaaaguggggaagagagaggugggagaguaugacaggcaggucccaccauuuuuuuauuagaaaaaugcugacugggaugccacguguaugccacguag

SEQ ID NO: 2400 - RNA, 72 nt, Oryza sativa
ugcgggucacuuaacaggcccgcacgcaaaaauaagccgauuuucgcgugcgggccuccuaaucuacccaca

SEQ ID NO: 2401 - RNA, 116 nt, Oryza sativa
gauucugauggggcuguggugauuuggaaccuagauggcauacuauaacaaguucugggauuuggauaugcauuuugagaguuuauggaccuagauggcacaucccuacaaguuua

SEQ ID NO: 2402 - RNA, 157 nt, Oryza sativa
uuuuuuacuguuagaccacucgucuuauuaaaaaaauuaugcaaauauaaaaaacaaaaaauaugcuuaaaguauuuuggauaauaaaguaagucaaaaaacaauaauaauaauuccaaaauuuuuugaauaagacgaguggugaaacaacgcaagc

SEQ ID NO: 2403 - RNA, 65 nt, Oryza sativa
uucgcaaguugcugaggcuguuugauaggcuaaguuccuaauuuaaaaaggcugcauauauccga

SEQ ID NO: 2404 - RNA, 292 nt, Oryza sativa
acaaccccuuuaggauccuacguggcauugaugugacaugucacacggauaugacaugguauuauuuugacuaacaaaugggacccauuuaaauuuuuuccuuguucuuuuuuuucuucucuuuuuuccucuuucuucuccuuucucugugacccgugcagaaaaaaaggaaaaaaagaagaaugagaagaaaacgaaaaagaaaaagaaaagaaggaaaaaaaagaaaagaacaugucauguccauguggcauugccacaucagcgccacauaggauucuagaggggaugu

SEQ ID NO: 2405 - RNA, 272 nt, Oryza sativa
uaguacucccuccauuucaaaauauaaggcacaaccacccucaacccaaagaccaagaaauaauuauuaucaucuuguaguuuagaucauccuaauaaauguaaugcaugcauccaauagaguuagagaaugugagagugaaggauuuaaaaaaguaguaauuuaauagagaauaugccauaguuaauggcaugcauucauguaugccuuauauuauggaauaucuaaaaaaauaugguugugccuuauaucauggaauggagggaguaaug

SEQ ID NO: 2406 - RNA, 82 nt, Oryza sativa
acaaaucuaguauuagaugugacacauaaccuauguccagauucauuacacuagaauaugucacauccaguacuagauucau

SEQ ID NO: 2407 - RNA, 243 nt, Oryza sativa
gagaccucgaugugcacuuugcaaguucgugggacuaagugaaaccuccugagaaguuuaaggaaauuuacuugaaaaaaagauuguaaguuaaguuuacuacaaaugaugucgacgauauuuaaagcuaggcgauacuauugaucuuguucuuaggacaguaauagaguggguucucuuaaauagaaaaagacacgcauguuguaagccauacgaugacuuagcacaggucagagggagguu

SEQ ID NO: 2408 - RNA, 85 nt, Oryza sativa
uuucggaacuuccaaaaaucauuuucggaacuuagguucuguguauuuucggaacuuccgaaaaugauuuucggaacuuccgaaa

SEQ ID NO: 2409 - RNA, 281 nt, Oryza sativa
cugguugcugucgccggcggugcgggggagugggaccgaccggagccgccauggcgcgcgugcuuccccaucgccggggaccgggucgguggcgaggcggugaagaagggaggcggggaggagacgaggacuagcuaaaccuuugccggccgcucuccgcgcuaucggccgcuccgcccaccgcucgcccgguccuccggcaggccagugcggcgguuggagcugccgccgucgcuccgcccuccuccucucccgccucgccccggcgaccuccucccgcg

SEQ ID NO: 2410 - RNA, 174 nt, Oryza sativa
ggggcaucuuugcaggcgggccauauaagcgucgucugcgaagaucaaucuucgcaggcggaccauauaagccucgccugcgaagaucuaucuucgcaggcgcacgacgucuaccgcuugcgaagaucgaucuucgcaggcgacgcuuauauggaccgccugcaaagaucaauc

SEQ ID NO: 2411 - RNA, 77 nt, Oryza sativa
agucucgauugguguuaccaacuggguguaaauaucugcaugaucuuuagucccgguuaguguuaucaaccaggacu

SEQ ID NO: 2412 - RNA, 90 nt, Oryza sativa
ggcagcgugcucaccggagagaagguggcggccggaggagagagccaugucgucgccgucgccgucgccgucgccuccgggucgcgccgc

SEQ ID NO: 2413 - RNA, 178 nt, Oryza sativa
aauaggaaacucacaagauaauuuuuauuacugacaauaaguaccauaauauagagugauauggcuauguauaaaugaagcuauuuucuacuacuuaaaaaaacaagacuuacaaagauuuaaaugacuuaaaugcacuacaugucuucaguggcagagcuuaguggaggccauccua

SEQ ID NO: 2414 - RNA, 170 nt, Oryza sativa
uccuuuuugcuaucaccaucagcugaccuuuguuuaccccaugcgaaaagucuauuuuuaccccuagaauauaugaaaugcuucuuaggaugauagugcacuucuaaggguaaaauagacuuuuuccauagggauuaacggaggucaacugacugugauggcaaaagaaa

SEQ ID NO: 2415 - RNA, 99 nt, Oryza sativa
gguuauuggguggaugugacacaucauaguacaaugaaucuggacagacggucuguccagauucauuguacuaggauguguuacagccauccaaaauca

SEQ ID NO: 2416 - RNA, 102 nt, Oryza sativa
gauaauucauuuucacuggaggccgucuuaaggcaaccgccagcgaaaauggauuuuugcuggcggcuagcuuaagacgaccgccagcgaaaaugaauuauc

SEQ ID NO: 2417 - RNA, 60 nt, Oryza sativa
uuuauuuggauacucgugguuaugaauccuagaugauuuauauacguguaucggugauuu

SEQ ID NO: 2418 - RNA, 91 nt, Oryza sativa
aucuuuaucuugaguauguuuaguuaucuauuuuagucugaguuuuuuacuuaguaauaaauaugaaugcaaguauguuuaaucccuaccg

SEQ ID NO: 2419 - RNA, 155 nt, Oryza sativa
cguacacugagagagagaauguucguuauuucuauaucgcuccaaggccgaacauaggcauguuauuuuacaaaucuaaucuuacugugugacaugcauacuggauccaacagcuuuaguugaaaucgacgaacagaucuuuuucuuuuuuuuuc

SEQ ID NO: 2420 - RNA, 284 nt, Oryza sativa
uuuagauuuuagacuggcaugcuucuuguuaaauggagagaacgaaagagagauaggguccucugcaauacucaccugagccuauggcagcuccaacucucagauucaccucaguucugacuagagcgcaaccaaacgguccagcuccacaaaaaaauggaguggaguaggccagaucgcuccaaaaaauuguacuagcugcgcucccaacuccaacuccagaggacccuaucucucuuucguucucucccuuuaacaagaagcaugccggucuaaaauuaaaa

SEQ ID NO: 2421 - RNA, 246 nt, Oryza sativa
ugcuucuuguuaaauggagagaacgaaagagagauaggguccucugcaauacucaccugagccuauggcagcuccaacucucagauucaccucaguucugacuagagcgcaaccaaacgguccagcuccacaaaaaaauggaguggaguaggccagaucgcuccaaaaaauuguacuagcugcgcucccaacuccaacuccagaggacccuaucucucuuucguucucucccuuuaacaagaagca

SEQ ID NO: 2422 - RNA, 66 nt, Oryza sativa
cggggcgcggcgcgacggccguguggcgguggccaccggcggcggcggcuguggugcgacggccuu

SEQ ID NO: 2423 - RNA, 214 nt, Oryza sativa
uaggcuacuuugugcauugagaagaugcuguuagaugagauuguuauugauacuaucaucacugauuuugcaucuagaacuguuagaaaaaaauguuuuaaaugaucaagagauauuucuuuuaguauuuuaaacuuauuagugugaaauucguuaaugacaaugaguuuuuaaauauuaugucuuguauuuuuauggugaaugggggccuuca

SEQ ID NO: 2424 - RNA, 139 nt, Oryza sativa
cuaagaaauacuuugaucggcagaugacaguagagcaaaaguuuagugcccaccuugugccugagcaacauagaguucgacaagccaguaguggguucaaagaguuugcuuauauuugguggucuagguuagauguugg

SEQ ID NO: 2425 - RNA, 68 nt, Oryza sativa; identical to SEQ ID NO: 2263

SEQ ID NO: 2426 - RNA, 159 nt, Oryza sativa
auuuuauaacucggugacaagaugagggaccuccgguauacuuuuuccaaauuaaaacgcucucggcuuucccaguuuugugagagaaugcauugggcuuuguuuccacgaggaaaaaguacaccaaaggucccugaacuugucaucgggauaaaaaac

SEQ ID NO: 2427 - RNA, 135 nt, Oryza sativa
aaaauggacgucggagauucaucaacgucaucacgaguaaaaaauuuacucgcaguaaaauuuuuacucaugaguaaauccgugaguaaaauuuuuacuuguggugacguggacaaaucuuagacauccauuuuu

SEQ ID NO: 2428 - RNA, 71 nt, Oryza sativa
caaguggaccucuuaaggaggcgcuugugaaaaucugauuuucgcauguagccacuaaggaggcucaccug

SEQ ID NO: 2429 - RNA, 76 nt, Oryza sativa
uuaggcccggucuuguggcaagaacugaguaguucguuaacucguuacccgguucuugucacaagaccgaguauau

SEQ ID NO: 2430 - RNA, 191 nt, Oryza sativa
auuagaaaaaugccacugcuauucacgauaucggcugggugccacuagaauuuugagaaauuagauccaugccacuccaucauguuuuccauccuuccugucaccuuuuccuuccucccgaacgacgacaacgaugacgaacccucgcugcagaggccggcaucgugggcggcagacggcggagucgacgg

SEQ ID NO: 2431 - RNA, 152 nt, Oryza sativa
auuacacagauggaggcuaauuuugcaagaugaaucuaucaagccuaauuagucuaugauuugauauuauagugcuacacuaaaugugugcuaaucauggauuaauuagaguuaauagauucgucucgcaaauuagccucuauauguauaau

SEQ ID NO: 2432 - RNA, 233 nt, Oryza sativa
cucuucuucuucgucugcaggcggcggugggcgcucgaggguccgagcggccgcagcggcgagcgggagcggaggcggcuacccaacggcggcaggaggagacgccgcucaucgggugaugcgccaucccagaguaugacgcccuugagcuccucgcccaccacgacgcgcuccaccugcacgcucucgucggacggauucauaccgccgccgcaugccaggccgaugccgcu

SEQ ID NO: 2433 - RNA, 215 nt, Oryza sativa
gcuucaccaucaucuuuguugggacauuacccucaucggugacagaguuuuguuaacgccugucccgccaccgauuaccucugacgggcugcaaccaaacccgucaccgaugagagucaucggugacgggcauggcccugaggacucagauauugccucucucggugccucugugauagggcuuuuuguggcucgacaaagaugaguaccuuuau

SEQ ID NO: 2434 - RNA, 142 nt, Oryza sativa
aaaggugucgguucucgauccaaaaccggcaccuuuaauauucucccuccgacacuagccguuggugggccccacacauaggugccgguuuuuuguaugacaagacuaaggugccgguuuuuggucuagaaccggcaccuuu

SEQ ID NO: 2435 - RNA, 64 nt, Oryza sativa
agggacccacuugcagcguggcuacauguggcaugccacguuagcuggaugcaggcaucauaaa

SEQ ID NO: 2436 - RNA, 103 nt, Oryza sativa
guccggugagagggagagagcgcgcgccgcagagagcgccucgaggguuuggagggagcucuguacaggcgguuucgcgguagugcacucuuuccgccgaugu

SEQ ID NO: 2437 - RNA, 271 nt, Oryza sativa
aaauacucccuccauuucaaaauauaaggcacaaccacccuuaacccaaauaauaagaaauaauuauuaucaucuuguaguuugaaucauccuaauaaauauaaugcaugcaucuaauaggaucagauaacaugagaauggaggauuuuaaaacguaauaauuaaauggagaagaugcuauaauuaauuauaugcuugcaugcauaacuuauauuauauaacaucuaauaaaagugguugugacuuauauuauagaauggagggaguaaug

SEQ ID NO: 2438 - RNA, 290 nt, Oryza sativa
acuccgugcauguguuuaaauauuugaugugacauggcgaaaaauuuugcuagaggaucuaaacuuuuucguuuauauuuaauacuccguguauguguucaaacauuugauugcuaaggugauuuuugaaacucauacagauuaagacgaagcuuaaguguuuauacaaaacgagauuguauuaacguauaauuaauugaguuuaauuaaguauuacaaauuuaaaaaauauauuuaucugauauuuuagaauaacuuucauauaaaauuuuuuuuacacaaaacauacc

SEQ ID NO: 2439 - RNA, 309 nt, Oryza sativa
gauggccagguuacccgccuugcggccguacccgucgucggcgagggcggccuucagcucgggcggcacgcgcagcccccacuggaaccgcaggcucgccuugcuccacagcggcagcacgcuccuggucgugaggcgcaucccggacagcagcgcgccgaccccgccgccgcucuuccccgcggcggccacguucgcggcgaacccguucccgcugaacgagaacgcccuguggucgucgccgccguuggcgaggucggucagcuugugcgacggcggcggcggcggcagcggcggggccggggacgc

SEQ ID NO: 2440 - RNA, 79 nt, Oryza sativa
gugaggaugguguggccaaauaacgcugccacgccagccagaucggcgugacaauguuauuuugccaugccaaucauga

SEQ ID NO: 2441 - RNA, 286 nt, Oryza sativa
uuuaagauuauaggguugccaccuuaaugggaaaguaaagccaucucucauguaaguaaaauagaacuucucaauuuggugcacaauaaauauauucccugauauacaagagagagguggagaggagagugacuugauuauggguuccaaauguuaauuaggagaugaguaacacacuagagcuaacaaugcuaagcugcgagacugcuuuauagcuuguuuggugcgaauucacacuguagauggccuuacuuucccauuaaggugacuaccuuauaaucuauaa

SEQ ID NO: 2442 - RNA, 233 nt, Oryza sativa
ggggacauucucucauugcuugcaugucauccaaauguuuaugaaaaaauuaaaaaaaaucaacuggauagauuaauaugugauagauaacuucauaaacaugcaaguuaaaauuaaacuucuacaaguugcaaaaaacuacaacuaaucuaucacauauuaaucuauuuuauuauuuuuuuaaaaaaaauauaaccauuuagaugacaugugaaugaugaggggauguccuc

SEQ ID NO: 2443 - RNA, 310 nt, Oryza sativa
ucucucggccugaaguugauggccuugcacugaaccguucccgagaaaaaaaaccccggugaucagcgguuuucacaaaaaccauuuggaagccauugguuuccaacaaaauucuuuccaauuuuguuuuaaaauaguaaaauucgaguuuggauuuucuuuuuuaacuugaauaacuuuuuaagaaaaaugaguuugguuuuuuuaugaacuugaugaaaacuggugguuuauguucucaagccaaccaaagacugguuuuagugauaaacggccggucuuguaaaccauuggugaggcacucuauuac

SEQ ID NO: 2444 - RNA, 69 nt, Oryza sativa
aaccuaguauuggauuugauguuuucuaguacaaugaaucuagaaaaaugucccauccaauacuagguu

SEQ ID NO: 2445 - RNA, 277 nt, Oryza sativa
aacccuugaucgggauggcgguuguccaugcugccuaugggguuggauucuugccacacgauccauuguaccgcuacgugcugaugaugcaguucgcgcugccaccugcaaugaacaucgguagccccugaaucccaugcaguuucauucugauuucugaaguuucuucuguccaugcuucuaggaagaucuugaucaccugaucaugugucuugugugugugugaucuguucgauccaggaaccauggcucagcuguuugauguuggucaagagga

SEQ ID NO: 2446 - RNA, 272 nt, Oryza sativa
aucggucaaaaccuagccaggagaauguggugcuggagaagaugggcuuggaugaauauaucaaagauguauccacugaugacgcagcugaacaagcuucuaauaugaggucucagauaaacauuuuaugggguaugcuacuuuaugaacguucaguuguggaguuuaaauuaggccuuccaaugugggaggauugcuugauggcagcuauugaaaaguucaaacuuggaggggcuucagcuacagacauugcuguguugguuaaaaaccac

SEQ ID NO: 2447 - RNA, 80 nt, Oryza sativa
ggcaucccuccggaccagcagcgccucaucuucgccggcaagcagcuggaggauggccgcacccuggccgacuacaacau

SEQ ID NO: 2448 - RNA, 59 nt, Oryza sativa
gagucauuccauauuuaguggacgaugguuuguccauucuacaauaugcugaugauaca

SEQ ID NO: 2449 - RNA, 64 nt, Oryza sativa
gcggccggcuuaacacaaccgccagcgaaaauugucuucacuggcggcuggcuaagacaaccgc

SEQ ID NO: 2450 - RNA, 112 nt, Oryza sativa
auacucccucuaucccaaaaaguguccaacucuagggauuaauauacacacacccccuguccuugucuagauucaucacuagaguugaacucuuuuugggauagagugaaua

SEQ ID NO: 2451 - RNA, 82 nt, Oryza sativa
uuugccggcaucggcugauucucugacgagcccuugaagaagagcuaaggucuugggggcaucauagccgauaaccggagga

SEQ ID NO: 2452 - RNA, 295 nt, Oryza sativa
gucauugauauugugguccaauaugacggcaccaauaacauugccgccaauccccucgcccucaggugaaaacuaagccacuaaugugaaagggauggcgucacauugacaccgaggaccuauuccuaucuguaaucuccaugccaacgauguugucacuaaggauuuauuugaaauuuuuuauuacaacuagguccuuuuuuauuacaaguagguccuuuuuuuuaaaaaauaaaaguugguccuugaugccaacgucguucgcgcugucauguuagaccacggcaccaaugau

SEQ ID NO: 2453 - RNA, 86 nt, Oryza sativa
cuaguaugguggguagggggagcucacggaugagaugauugaugaugauggcaggucagggcucucccuacauacgguguauaaau

SEQ ID NO: 2454 - RNA, 159 nt, Oryza sativa
ggaguuugugucgaauauguguauguugucgguugcaguauaggacuuggaguuguauuagauguuaggaauagaguaagagucugucucuauccuaguaucucucuuaaauagagggguggaccugcuaugaccacauggcgauuuagcauagcgaga

SEQ ID NO: 2455 - RNA, 79 nt, Oryza sativa
uacuaaaucauuuccgaucguuggaccuagcuagacaggauggguauuguuagauccaacaaucggaaacgauuuuguu

SEQ ID NO: 2456 - RNA, 211 nt, Oryza sativa
cgcacucauggaugaagugguagcgcguggcgaugugcuuacuccgguuaugaaacacuggauuuuugcugagggcgaucgccgauuuauugucgacgaggagcuugaagcuuuguggcuccuccugcucaauuucugccagcaacugcgccagccagauccccugacacgccgccgucgucgccgcuauguacuccgccucacaagacga

SEQ ID NO: 2457 - RNA, 311 nt, Oryza sativa
accaagugcaucuucaacccugguugguuccaaagaagagacaaacgaauaguguuaacaaaaguuagcgacacgagaacgaguaguuacccccuuucuuaugucaccaaguauguugucgaugggaugaucucuuugaacagugugauguauucuuggauggugcaccgaggggaccugagccugaucaggaugcucuauagugcccucagcuucaaucccauccacuugugccguaggcacgccuugacuguccucugcccggaaauuccuggcagauggacccggaacuuccuggccuggagaggucc

SEQ ID NO: 2458 - RNA, 95 nt, Oryza sativa
ggauuguucuccgucaacuuagucgaugcuaucucgaucucagugguuguuggguaaggagagaucggcacgacugcguagauggggaagaugau

SEQ ID NO: 2459 - RNA, 195 nt, Oryza sativa
ucacugugcgguaagaugguucagugauguuugcucgcauggagaagucauucagaacaaugcuacacuugaaugccuccuaugaagaaacacauaaauagcauaucagaagcaaauucuucaaagauggauaacaugaaacuuuuucggaacaaggguauauaugcagaauggacugucguugccccaaauuaa

SEQ ID NO: 2460 - RNA, 264 nt, Oryza sativa
guucaauuaaucuuugguuuucuaugcaauugggcagggcaagaggggugcauguagagagauuugauagagagguuugugggaggaaaacauuccuucuugccuugaauguuuauguggcuuuuucuccuuaauuguuuauugaugauuguggacuagugucuagugguuguauuuuugugguuuaggaggauguguaagcuugcuagcuuguugaacuugauuugcuaugcuuguguuaggaaccuaggaucaaauaauggu

SEQ ID NO: 2461 - RNA, 306 nt, Oryza sativa
cgaacaacacugccgcuugccuguguguccugcuuuugccucggugaauccauccucgugucggcagucgucgucgucgccgucgccugcgcaaccgccuccgaugccgccuucaagauucuaggguuucggugugagguugggaauggauagcgaggucgcgcugacaaucaucgcggacgccaucgucgccgccuucgagaucuaggguuuuggugugagguagggaauggauggcgagcucgucgagccagaccacgauggcuuacaacccagcgacacgggggcauuuugguccauaugaaa

SEQ ID NO: 2462 - RNA, 217 nt, Oryza sativa
guuaguuaccucauaucuaauagguuaaggcgguugggcuauauuauguauggauaugggcuauuacucuauauuauguguucuuuuuuguuuuguugaacucuaugucuuuuggacccuucguggucuuguaauagcccuuguuuauuugugagcccuuuuuaggaucauuugugacuuauguguuuugaaugguuagugaugugaucuugugcua

SEQ ID NO: 2463 - RNA, 122 nt, Oryza sativa
gacgggaucucgaccucgacauccauaucccacuauaacuugcuaccguugccacuaucuuauguuagugacauugauagcaaguucgagugggauacugaugucgaggucgaguucccggc

SEQ ID NO: 2464 - RNA, 82 nt, Oryza sativa
uugcccacguucacauagaugucaaugaaucuagacacauguaaguguauagauccauuaacaucuauaugaauguaaacag

SEQ ID NO: 2465 - RNA, 310 nt, Oryza sativa
ggaaaauuguugggcugcuuuauuuuaugggcugaauucuuucacggauuaagcugggccaauuuuauuuacgggcugaauucauccacguaaugaggugggccaauuugauuaacaggcugaauucguucgagagauuugauaauuugacacuccuuaaauuauuucacauccugaguuccugaccaauuucauucacucacacgauccacauguucacaaaacgauuuaggccgaaaagaagugggcuuaauuuaucuauguaugggcugaauucauccauagaaaauaagugggccgaauuugauua

SEQ ID NO: 2466 - RNA, 310 nt, Oryza sativa
auaguaccaaucccaggaugcacuagcugguacacacagaauaaauguggaaucaaaguaaacuacuuuauuacgucacuggguaguaguccuuacauaaguugccaucauggacagacccauagaugagcaacacaacaacacagaaaaacauaaaagcaacggcgcaaaagcgaacaacgcggagagacuaagcgucuaaacgacuacgcacuaggcacaguuccuaggcaacuaacuuauuccacaggccaggcuugggccuaggcacgaaacaucuagaagucuucauacucggcuugcuccugga

SEQ ID NO: 2467 - RNA, 69 nt, Oryza sativa
ucgguuuaguugggacuaucucgguuaggucugaucuucccucuuagccgauauaucucuacaaucaca

SEQ ID NO: 2468 - RNA, 311 nt, Oryza sativa
ggugguggcccguaguaggccguaggcguagacggcggguggacgggugguggaugaguacgugcggcuuuuccggggguuuuuccucggcgcgcgguugcguuugugucggugaggggaggaaaucccgcgugugccgugugcgcggugcgcgugagagagagguuggcgauucuugcgugcggcgucugggguguuggaaggaagaauuccccgugcgccgucgggacgcgggagucgggacgggcggccguccgcucuaagagcaaggcgccaauaauauagccaacuacugucuccaaaauauuuau

SEQ ID NO: 2469 - RNA, 114 nt, Oryza sativa
ucccgaauaaguccucuuucaguuuggaggacauuggagggaaauuauucuccgucaaauccccuccaauucucuucaaucucuuccaaaccgaacaaggccucuuagggauua

SEQ ID NO: 2470 - RNA, 298 nt, Oryza sativa
guaacuuuagucucugcacaucggauguuuggacauuaauuagaaguauuaaacauaaacuaaugacaacucauuccauaacccuggacuaauucgcaaaacgaaucuauugagccuaauuaauccaugauuagcccaugugaugcuacaguaaauaugugcuaauuauggauuaauuaggcuuaaaaaauuuugucucgcgaauuagcucucauuuaugcaauuaguuuuguaauuagucuauguuuaauacucuaaauuagcgucaaacaucugaugugacauggacuaaaguuua

SEQ ID NO: 2471 - RNA, 215 nt, Oryza sativa
uauuagcugauacgugcuagaucuaucugaucggcuaugcugugaacaucuauauaauuguuguguuagcgcauaucucgacuuaagugauuuauacugucucggcauggcgaccgaucuaucccaaucacuuaguuuaaauauacauugacauggugauuauauauugcuaacaucuacagccgaucgaauagauuuaguuuuaucuuauuuau

SEQ ID NO: 2472 - RNA, 206 nt, Oryza sativa
cgcuugaaauccaucccauccauccuuggcuuacuuaucuagaucaaucacaauggcuaagcuuguggcucuuaccuucguugucuuggugagcauuggacuagccaaugcuggaaggguggcuagauaugcuagugcaggcgguggcggcgguggagggggagguggcggugggucaaacgguggaucuggauggggauccgguu

SEQ ID NO: 2473 - RNA, 281 nt, Oryza sativa
ucgauucacgucaccgguggcugccccggaugcugcgcugcacgcccccuccgggcccgagaggcgccggcggcagcggauccaccgcucccgcgccuggcagcgguggagacggaugccggcacggcaagcggcgaagggggaggaagccggcgcggugagcggcgcccggcggcggcggagacggaggccggcgcccagcagcggcggagacagaggccggcggucucaucugcaguagcgccucgcgugugguggcggcuuaucugauuuggaucggc

SEQ ID NO: 2474 - RNA, 198 nt, Oryza sativa
gcgggcgcggugccgggagcugcacgaccgcgucgcggcguccccuucccugcagcggcaccccgcgcugcggucccuccuccgccucgucgccgccgagcagcgguuccucgacucgagccggcccgaccagggggcgccgcucuccaccaaccugccccaccucgccgcgcugcaccuccuccucgccgcccaccc

SEQ ID NO: 2475 - RNA, 246 nt, Oryza sativa
gaacguccgguaucugguuuugcgauugggggacgauuuuguguuucgaugacaaguugagggaccuuggguguacuuuuccccaaaaacaaccuacaugccacaaccacauaauuuggcccacaaagaggccuagcaaauuugggccacucccaggcccagaaaacauuaccaagucgaacaccgcaccagccaucaucgcuguccucucuccucuccucccaacgcggcgaccgacggccgagg

SEQ ID NO: 2476 - RNA, 265 nt, Oryza sativa
cggaggauguggcggugggcggacgagugggcgcaggcguaccaguacuacgaggugccgcgguucggcggcggcggcggcgaggggguggagaauccgcuguucaggaaggcggcggcguacguggcggcgcugccgucgcuggaggacgcggacgcggcgugcgugcugucgucggcgugcaagaccaacgacuucucgcugcagcucgggccggggcacacggcgcacgacgcguuccucggcgcccgccucgcguggacca

SEQ ID NO: 2477 - RNA, 125 nt, Oryza sativa
aucgacucccuccgucccaaaaaaaacccaacauguaugaaaugggacauaaucuaguacaaugaaucuggucagacuccuauauacauacuagguuagguuuuuuuuugauggagaaaguaugu

SEQ ID NO: 2478 - RNA, 171 nt, Oryza sativa
ugauauaucacuccacaaauaugcaaguaaaaauucaacuucuauaucucgcaacgaaaaaaacaaauuugacucugaauauacguuaacuagcugcgguucaauuuguuuuuuucguuacgaaauguagaaguugaauuugaacuuguauguuuguggaguguuauauua

SEQ ID NO: 2479 - RNA, 129 nt, Oryza sativa
ucgacacagaguggggacgaggagcgguggcugggagcgugcucccaucucccccgacgcauuccgucgcacgucgcccgagguccaccgcccaccgcagccaccacuccggcacccacucgcugaugc

SEQ ID NO: 2480 - RNA, 115 nt, Oryza sativa
acaagagaccgagauuuauuccagguuaggaaucaauuuaaucguauuagguauaacaaaacauccggauuaguuccacacuucuugacuaguggauugauucccggucucuuau

SEQ ID NO: 2481 - RNA, 258 nt, Oryza sativa
gucaugacugauaaauaggacccacuuaaaauuuuucauuuuuauuuuuuucuuucucuuuucucuuuuuccuuuuucuucucuuguuucucuuuuuuucccuuucuccuccuuccucucaagaccaucgccgcauggggugcuuaggucacaaagaaaggagaagaaaagaagaaaaaagagaagcagaagaaaaagagaagaaaagaaaaaaagaaaagaaaauguuuuaaguggaucccguuugucagucagaug

SEQ ID NO: 2482 - RNA, 300 nt, Oryza sativa
uccaugcgguugggcaauuuuuccaucgccagugcaugcagucaaugcuucccaacaucccagggaauccacgagacucuccaacuuggagcaaacgcucgagauccucagccgugggacgacgcagguaccuacuacuaaauaccucgacgacaccuuccacaaaauuuucuaagcacucuagagcaguacucuggggaaccuucaaguacucaucaagagugucagcagcagucccauaugcaagcauacggaucgcugcagugcacuucugcaauggugagugcccaaggcauccag

SEQ ID NO: 2483 - RNA, 309 nt, Oryza sativa
cucugggaauucagagggcuuaauagauguaaguaguuuccugauccauucuguucauucgugaguauacuguauacuccuucaaaauguaguucuuuuauacuguguuucuaugcaaaacaacguuaguuuacacuagguuugauaucuguccauacaaaaaaagaauuuugggucacacuugggguugauugauugaaaguguaacauguaacugggauuugguuggucuuggacacauuuucuuaucaugacacuuaacauggagaggaacugugcauaucauuugcccuuuuagaguaugagaug

SEQ ID NO: 2484 - RNA, 256 nt, Oryza sativa
uaacacaagauuggcuacaugagcaucgagaaaugcaaauauuaauaaaucgcuuguuuacgaggaaugacugguagcauguuuaaauggaugauaaguaaaauugcuuauucuugcucugugugccaagacgacgaaauaugacuaucaaaaguagcuggagugaguauuaaucaauaauaauuuguaaguaacuaauaauuaauuaaucacuaauuaauaauuuucaaucgccauggcagucgguaucgcugga

SEQ ID NO: 2485 - RNA, 148 nt, Oryza sativa
gguuaaaaugccuccagaaaaugcuuuugcauaugauucaaauuuuaaagugacgaaagaugccccuacaauauaaaaggcaacaaaaauauacuaaaaauaucucuaaagugucuauagaguaaaaguguucuaggcaauuuuaaaa

SEQ ID NO: 2486 - RNA, 93 nt, Oryza sativa
acucccuccgucccaaaauaaaaaaaaacuaggauaggauggagguuaugucccauccaauccuagguuuguuuauuuugggacggagggagu

SEQ ID NO: 2487 - RNA, 117 nt, Oryza sativa
aaaggacguucgagauuuguccacgucaucacaaguaaaaaguuuacucauggauuuauugaugagucacggugaaauuuuuacuaugaugauguggacaaauuccgaacauccauu

SEQ ID NO: 2488 - RNA, 180 nt, Oryza sativa
caacaucguauauugccguaauacgaugcagcuucacaccuuguugggugugaaggcaggaguacauaucauugcauugcauaugcauuuauucacccuguugggugugaaagcaggaguacauaucauugcauugcauauguacauauugcaggauguuacgugaaauaucgaucgaag

SEQ ID NO: 2489 - RNA, 159 nt, Oryza sativa
gcaggaaaacaaggagggucuugagcucuugaagacugcaauugaaaaggcuggauacacuggcaagguuuguguacuuugauuaauuuauuguuuaucuuucugcauaaguuaauguuuuugauugacugaggcuugagacuuuuuuugcaaccugau

SEQ ID NO: 2490 - RNA, 308 nt, Oryza sativa
uuucuugguacauuacauauuaauagcuaguaaguauaguuucuacaugaaaaugcgauucagagcuagcacaaucuaaaucccuguauugcaaaauccaauaagcaaaaaaaauaaugccaauacuguuggcucgaaaaaucaucuuccaaccgugccgcgaccucaagugcaaaguucuagcauuggccuugugaaaucauugucaugauuaauauuugugaggaauaauuggcuaugcaaaugauuuaaucaaugaauugguuugagaguaugugugaauguuggugugagugugugacuaaugu

SEQ ID NO: 2491 - RNA, 238 nt, Oryza sativa
auauacuaacuccgucccauauauauuguaauucuaguuuguuuagcauauauuaagguuugagaagaaagauuacgaugccccuuauuaaaugguguagugguaagaguggaaggguaguugaggguaaaauggggagaaauuugaaugggaccauuaguacucuauugugacaauuauuuugggacaaauucaaauucuagaaauacaauuauuaugggacagagguaguagcuac

SEQ ID NO: 2492 - RNA, 113 nt, Oryza sativa
uggugccacauggcgacuuaagagcauuuauaggagguuuaauggacuuuuaguauauaauagauagcuaauagauagauagauagauagacgguaggagccacaugucauac

SEQ ID NO: 2493 - RNA, 206 nt, Oryza sativa
agcugacacauccaggcaaggguggacgugauggaguucgaauggguccugcgacggccuaugcggcuugcugauucgccuaggcacgagaaggggcugcccgcugccuguugaggaccaggggcgaaaccuaagguguggugugcuugguuagaggggguuaugcgaaggguccugucacggccucuuuccgguaugucguggcu

SEQ ID NO: 2494 - RNA, 69 nt, Oryza sativa
uuguugccgguuugccucucacuugauguuuugcauuguucauccaaugugcaaggagaccuugaggca

SEQ ID NO: 2495 - RNA, 69 nt, Oryza sativa
ccgcaacucgucgucgccgucgucgcaccgcaucacgcauccggccgacgccgccaugaccagccgcgg

SEQ ID NO: 2496 - RNA, 124 nt, Oryza sativa
ccauccgauuacacuauuguguucguuacaauuaaaucuucacaacaagaucuuacaugauuauauuugcaagaucuuguuauaaagauuuaauucuuacgaacacaacgguguaaucggaucg

SEQ ID NO: 2497 - RNA, 153 nt, Oryza sativa
gcgcccaucaccgaugagaccuaucggugacaggcuuauguuuaggcccgacaaagauuaucucuguaaucuuugucaggcccuauauuucuuaaggcccgauaaagauaauaaauaggcccgucacggaugguugucaucggugacggguuc

SEQ ID NO: 2498 - RNA, 188 nt, Oryza sativa
uaucuacggguuucugugucuaacauuugauauccguuuuauuuaaauuuuuuuaugauuaguacuuuuauuguuauuagauauaaaacaugaauaauaauuuaugcgugacuuauuuuuaaauuuuuuucauaauuuuuuuuaaauaagacagacgaucaaauguuagacacagaagcccagaaaug

SEQ ID NO: 2499 - RNA, 100 nt, Oryza sativa
acgacaacaucucauggguaacgagucgaucaaccaacaacuugccuuccuggcgaggggaccgucugggucgaucgcgacauuccagagauaugagauc

SEQ ID NO: 2500 - RNA, 63 nt, Oryza sativa; identical to SEQ ID NO: 1912

SEQ ID NO: 2501 - RNA, 292 nt, Oryza sativa
acggaagagcucaccggccggccauggcacaaaacuucuugagcaagaauagacuacuccauccguucuaaaauauaagggauuuuuaacggaugguacuacuaaaaguaucacccauuucaaauaucuuauauuuuggaacagaugaaguauuauauaugucaugucgugccuucuccguucuaaaucuauuguauuuuagggcggagagaguauuuauguaucuacggucaccgaucuuucucaaguacuacauccgucccauguuacuugucgcuuugaguuuuuguuu

SEQ ID NO: 2502 - RNA, 79 nt, Oryza sativa
gaaccagcgucgccgucggccgccgccgccgccgccuggcucuuccuucaugcgcgcgccgccgcggcgaagcucaguu

SEQ ID NO: 2503 - RNA, 75 nt, Oryza sativa; identical to SEQ ID NO: 1668

SEQ ID NO: 2504 - RNA, 252 nt, Oryza sativa
aaaaauguggucgaguucaucacacaugggcuugaggcuccaacacagcaccuuacuguucgauacagagggaacaccuugaauuuuguuaugugucagcgauaacaaagggcgggccacagauaggugagcgaaagggcgagaaaauaguagggagacgguguuugccaugggagggugagccaaggugugacaaaggaguaagacaacgacaauggagcccuugcaaugauaaaacucgaauuugcaaag

SEQ ID NO: 2505 - RNA, 310 nt, Oryza sativa
auuuuaauauuuacagaaauauuauaccagcgaaaauauuuacagaaauagaucugccgccaaaguguagggcagcaaggugacguggcacauggcgccgugugcgcauuuugcgcugaggucccuugcuaguugcuacccucugcaagggcggcaagggggugaaaugcaauuuucgccacaugcaaaauuugcaugcccacucagcagccuccagcacuuggucacacacgucacucuaccacccucggggagggcugcagagccuauuucuguaaauauuuucgccgguauaauauuuauguaaaua

SEQ ID NO: 2506 - RNA, 157 nt, Oryza sativa
guuuguacuguuugacuauucguuuuauuuuaaaaauuuaaaauuauuauuuauuuuuuuuacuuacuuuauuaucuaaaauauuuuaagcacaacuugucguuuuuuauauuuggauaaauuuuuuuaauaagauaaguggucaaacaguauaagu

SEQ ID NO: 2507 - RNA, 75 nt, Oryza sativa
cagcggcgcggggcggacccgugucggggcguagcgugugcucgcuggccggcgacgguucgccucccucccucc

SEQ ID NO: 2508 - RNA, 111 nt, Oryza sativa
guuuugaugugauagaaaaguugaaaguucgaagaaaaauuuuagaacuaaacucagccuuaggccguguuuaguuccucccaaauucccaacuuuucaucauaucgaaaa

SEQ ID NO: 2509 - RNA, 206 nt, Oryza sativa
agaguggcauugcccuggggugucuuaguccuuuauuacauuaguuaacacaacacccaagaaguuauagcuaaagaucaucugcuccuccugaaucuuggaacuagcagauaaggggguacuguuggaguauaaaccccauuccuaagguguuguguuaaccaauguaauaaaggacuaaaacacccccagggcaaugccacucu

SEQ ID NO: 2510 - RNA, 65 nt, Oryza sativa
aguacacuaccaguauugguagugccaaaacucuuuggcacuaccaucuuuggcaccuacuaaua

SEQ ID NO: 2511 - RNA, 120 nt, Oryza sativa
ucauacucccuccgucccaaaaaaaacccaauccuggguuugaaccuggacaagaaggagaucacauguguccagguucaaacccaggauuggguuuuuuuugggauggagggaguauau

SEQ ID NO: 2512 - RNA, 114 nt, Oryza sativa
caagagacuggaauuuauucugggucgagaaccaauuuacucauauuagguacaacaaaacaucuggauuaguuccacaccucuugacuaguggauugauucccgaucucuuau

SEQ ID NO: 2513 - RNA, 79 nt, Oryza sativa
uuaacuccagugcagguccaaggcuagccucgagugucucaaggacaugccagcugauuuugggcguguuugguugcug

SEQ ID NO: 2514 - RNA, 67 nt, Oryza sativa
auuccuugucgagauccaccaacuguucucgagcgaucgagaaggcguagaaucugcgacgaagccu

SEQ ID NO: 2515 - RNA, 85 nt, Oryza sativa
ucacaggcccuaucuugugguaugaacugaguacgcgaugauuuauggcgcauauugggggcuuaccaaaagauaaugcugugaa

SEQ ID NO: 2516 - RNA, 81 nt, Oryza sativa
uguuugucgaugugcgacuacggauccggcgccggcgacgggagcgagcaacggauccauagccagcgacgggagcaggca

SEQ ID NO: 2517 - RNA, 142 nt, Oryza sativa
aaaggugccgguucucgauccaaaaccggcaccuuuaauauucucccuccugcacuagccguuggugggccccacacauaggugucgguuuuuuguaugacaagacaaaggugccgguuuuuggucuagaaccggcaccuuu

SEQ ID NO: 2518 - RNA, 155 nt, Oryza sativa
agauauauguugacaauucgucuuauucaaaaaaucgagcaaauauaaaaauauaagugaggcuuaagguauauuugaugauaaaacaagucauggcaaaauuaaugauaccuguauaacuuuuuugaguaagacgaguggucaaacguagauuu

SEQ ID NO: 2519 - RNA, 224 nt, Oryza sativa
cucuguuuuuaaauguaugacgcuguugacuuuuagauauauguugacaauucgucuuauucaaaaaaucgagcaaauauaaaaauauaagugaggcuuaagguauauuugaugauaaaacaagucauggcaaaauuaaugauaccuguauaacuuuuuugaguaagacgaguggucaaacguagauuuaaaagucaacggugucauauauuuauaaauggagg

SEQ ID NO: 2520 - RNA, 308 nt, Oryza sativa
cuguuuugauguuucaauaucagguaacgaaggugacaagaguccccaggauuuugcugacugugucagccaagagcaaccucaaaaggacaucauggaggccguugcaaagucuguccaagaugccuucacuaaaaucggcuuccugaaccacauggagagguuggacaagcggauauccacgcuaacugauugggucaccgcguuggagacaccuuccaaugaggaaguggugaguggugacgacgaugcucauccugaagacacgguguacgauuccaguggcuauauugacgcaccggcuacaa

SEQ ID NO: 2521 - RNA, 69 nt, Oryza sativa
ugaaaauacggcggccuaggagaucugcuuaacuucagugcagguccaaggcuagccuugaguguguca

SEQ ID NO: 2522 - RNA, 285 nt, Oryza sativa
cacgcccaagaggagcuagauguuguugugggucgugauaggcuccucucagagucggaucuaucacaucucaccuucuuccaugcuaucaucaaggagacauuccgucuacauccaucaacaccgcucucgcugccacgcauggcaucugaggagugugagaucgcaggcuaccguauccccaagggugcagaguugcuggucaaugugugggggaucgcccgugacccagccauauggccugacccacuagaguacaagcccucucgguuccuccccgguggg

SEQ ID NO: 2523 - RNA, 279 nt, Oryza sativa
uauuugaauguguugugcaugguaccaugggaagaaaaacaaucaggcugcaagguuuaaucaacaaauaggaguacugauauugguggacucaggcaguucagggaauuucauagcugaacauuugguacagaaauugcagcucacaccauagcugaugggggaagaaugcagugcaacaguugugugaaggggguugagugguggugucaagggagcaguuuuguuacugaucucaaggugcuggcccuugguggauaugauauaauucugggaaug

SEQ ID NO: 2524 - RNA, 150 nt, Oryza sativa
ggucuucauaugacguggcaaugauguggcgcauacguggcaauuagauccagagaaauaauaaacuucauaggacccacaugccagucucacauaaauuaauaaaaauuuuguggggcccacaugucauucacagcgucucccucucuu

SEQ ID NO: 2525 - RNA, 74 nt, Oryza sativa
gcucuuuccccacuggugaguggcagcagcacccucuuccucuugcgcaaccauucccauggcccccgucauca

SEQ ID NO: 2526 - RNA, 147 nt, Oryza sativa
agagcacugcuaugcguaagacggauucguacuaccugcguccgaccauaucaugugcaccgaucaccgucuuuagcuucucuccaccaaugcaagcagcauucggaugcaugucguacgaauccgucggacgcauagcuauuuucu

SEQ ID NO: 2527 - RNA, 62 nt, Oryza sativa
agcucaguuguuaccuccgucccgugugauucuugaucaauggcgcgaggagcaucuuccgu

SEQ ID NO: 2528 - RNA, 77 nt, Oryza sativa
cgccggccgauggcggcagcggcgguggcgcggcucacugcggcgacgacgugccggaugcgcgucaguggcccggu

SEQ ID NO: 2529 - RNA, 78 nt, Oryza sativa
gcuguggcgguggcuacguugguggaggauucguccguugccaugagcucugauaccaaguugucacgagcuccggca

SEQ ID NO: 2530 - RNA, 68 nt, Oryza sativa
aggaaacauggcggccuagaacaucugcuuaacucuagugcagguccaaggcuagccucgaguguguu

SEQ ID NO: 2531 - RNA, 64 nt, Oryza sativa
cucacgcguugguagguggggcccauggaucagcucauccccuaccuccagccaccgccgcauc

SEQ ID NO: 2532 - RNA, 229 nt, Oryza sativa
accgccgauguggcgcuccacguaggcaacaauuuugcauccggcccccuuuugcaggacagcguggugguaauauuguacuuagccccuuugagccacaguaccaccccgaaacuccccgaaauccccaaaucccuccucccucacaggagcucaaaggagcuaagugcaauuuuuggaugaggcuggacgcaaaauaguugccuacauggagcgccacgucgucggu

SEQ ID NO: 2533 - RNA, 79 nt, Oryza sativa
ccgggggggccucgccagcgccguugaccccuuccggcuagccggcgaggcgggcggcggcgcgguggggcgguugcgg

SEQ ID NO: 2534 - RNA, 110 nt, Oryza sativa
aucuugaccucgacauccauaucccacuagaaccugcuaccguugccacuaucuuaugguagugacauugauagcaaguucgagugggauacugaugucgacgucgaguu

SEQ ID NO: 2535 - RNA, 226 nt, Oryza sativa
aaauuauuucuugagcuccgaaaauucgcgggaaauuucagagaguauuuuagggcacaaagaauauuacaaaauauucucggccaaugauuuuuuuaaaggaaauuuuaauucucucauuauuucacuugauuaaauugcuuuaacauuuauuuaauuucuagaaaaugcauuauuuaaugauuuuuaaucccgaacgaaaaucggggccuuacagaaguucaag

SEQ ID NO: 2536 - RNA, 61 nt, Oryza sativa
augcugcucacugauauguaggcccaauagauccuugagcccacaugucaguguguauuua

SEQ ID NO: 2537 - RNA, 109 nt, Oryza sativa
cagcggcgguggcucccggcggaggcggcaacggugguggcgcugcuccaccgcggaucgagguggcggcggcggcucccggcggcggcgguggcggcuucgucuuggc

SEQ ID NO: 2538 - RNA, 302 nt, Oryza sativa
gagccgaagcuguacaggucucgcccuuuugccucacauuugagcuuuacauaccggagcuugcuucaagacuuccaacauguaucgcauucaggcaggaaaaaguucuugcuuguuagggaugcucuuuugccccguguaaacgggacaaccgaccuuauuuaaacaucuauauauggaacaaacucaccucuggacauucgauuucgagugaugugccuugaucccuuuguuguaguuauacaggugccuugcaauggacaaagcuuuugccaaacgggggauaugugcaaaucgcucuc

SEQ ID NO: 2539 - RNA, 161 nt, Oryza sativa
ggauuaaacuggccucuacauccaaaauacauguacacggcaaaagauauauggacaacauaauugucgcuuuucacaaauacuacaggaguaugaccaucagugguguuuaccauuugggcuguguacauccauuguggauguagaggccggauuuuaau

SEQ ID NO: 2540 - RNA, 247 nt, Oryza sativa
gugaagaugaugcagagcagucgcgcuugaagcgcuaucuaaaaacuugaucgcucgccuacccgugcauguucucaagcggacggaguuucggaggcacuugcucguuccgaucacccgugcgcgcgggaugaacagaaccggggaaacagagagacagcgcaggaacagaaggagaguaucgccaaggaacaauaguaggaggaagauacacacuuugagagccucugccuugcguuauauguag

SEQ ID NO: 2541 - RNA, 154 nt, Oryza sativa
augcggcagaucagccaugauccaucagguucgacaacgguuuccacaaggggggugacggcgagcacauuacgaagaacugcagagagaccaucauuucucugcaaaacagucaccgaauugccuguuaauggaugcugcugaacgcacaaag

SEQ ID NO: 2542 - RNA, 110 nt, Oryza sativa
uaguacuaccuccgucccaaaauauagccacuuuuggcuauggaucuggacacauaguuauccagauucauagcuaaaaauacuuauauuuuaggauggaggcgguagaa

SEQ ID NO: 2543 - RNA, 95 nt, Oryza sativa; identical to SEQ ID NO: 1759

SEQ ID NO: 2544 - RNA, 148 nt, Oryza sativa
aguggggauuugaccauggguugcgcgguugagagcugcacgcacuagccaccacaccaucucguugcuucuguugguuuaagacauuuaauccuauaauacuuugaacugcgguuggaccggccuaaccaguggucgaaccgacaaa

SEQ ID NO: 2545 - RNA, 115 nt, Oryza sativa
acguuggggucuuauuuucguagucggacaugacuuuugaagccaaaugaccaccuacaaaaauauaaauuggggugauguucgcuguccgccugcgaaaauaagcggcgccugc

SEQ ID NO: 2546 - RNA, 217 nt, Oryza sativa
uccuauuuuaagugcaaccaugaguuuccguguccaaccuugaucgucugucuuauuugauuuuuuuuauaauuaguauuuuuauuguuaugagaugauaaaacaugaauaguacuuuacgcgugacuuacguuuuaaauuuuuuuucaaaaaaauuucaaauaagacggacgaucaaaguugggcacggaaaaucauggcugcacuuaaauuggga

SEQ ID NO: 2547 - RNA, 74 nt, Oryza sativa
cgacgcauugcggcgcggcggcuggcggcgguggggcggcgcauugcggcagcacgcggcggugugaaagggga

SEQ ID NO: 2548 - RNA, 142 nt, Oryza sativa
guauucaccugcaaacugcaccagcaaaguagagggaggaguacaguugaaucgaugcagcugaccuugcaaaagaaguagagggccaagcucuuguucuugcugcucuuggcugcugcugguggugguggugguggugggg

SEQ ID NO: 2549 - RNA, 129 nt, Oryza sativa
ucccuuuauguauagggaggauaggcuuggcauccaaguaacuaaucucuacuauuauauaaaccaauccaaucucuaauauuauuaguuacuuggaugucaagccgguccucccuauauauauaaaga

SEQ ID NO: 2550 - RNA, 63 nt, Oryza sativa
cgggcgccgcuccgccgcgucgguggucgccggcggcgaccaucggggcgcgggcgcgccgcc

SEQ ID NO: 2551 - RNA, 146 nt, Oryza sativa
ugguuuuuauuuuugcuggcggucgauuuaacacagccgccagugaaaaugaauuuuugcuggcggucgguggaagauaacugccagcaaaaauguaucuuugcuggcggcuggcuuaagacgaccgccagcgaaaauaaauuuuc

SEQ ID NO: 2552 - RNA, 282 nt, Oryza sativa
uucggguauucuguugauguuugauugcugggguuacagaauuuguugagauuuguagucgagauaggcaguuuuuuuuuucuuuuugugaaucagucuuaaauuggaguagugauuagcaaauauuuucuuuccauucuccaauugauccuuccuuugugaaaaauagagcaguaguuaguucugauuguuucugacagacauaauuaauacuuaaaauuuaaaauuuauaagcuucuauguucuuguauucuagugucgauaucgaugauucuccaguua

SEQ ID NO: 2553 - RNA, 211 nt, Oryza sativa
cagguuauacgacguucugacuuuggucaaauucaaacuacucuaaguuugauuaauuuuguagaaaaaaauaguaauauuuacaacacuagcagaguuucauuaaauauauaauugaauaaauuuuuauaauauauuuaucuuagguuaaaaauacuauuacauuuagaguaauuugauuuuguccaaagucaaaacgucguaaaccgua

SEQ ID NO: 2554 - RNA, 81 nt, Oryza sativa
cgcuuggaaacgacgagacgaaucuuuugagccuaaucauggacuaauuagacuuaaaagauuuguuucgugauuucuccc

SEQ ID NO: 2555 - RNA, 93 nt, Oryza sativa
ccuuaacuuuacacugaguucgauauuugucccugaaucacaauaccagaugcaaugggucucucaacuaucaaaaccgguguagaugagguc

SEQ ID NO: 2556 - RNA, 172 nt, Oryza sativa
uuacuucgauccagcaaaaaauauaucgagguacgauccucaugguauuaaaucguuuccgauccuuaaauccagcugggcagaauggcauuguuagauccaacaauuggaaacaauuugguaucgcgagauauuuguaccucgagauacuuuuuguuggaccggagcaaau

SEQ ID NO: 2557 - RNA, 98 nt, Oryza sativa
ugcccgcucgucagacggugcugggcgcccccgacccucaggaaggccccgaggccacugcgggaaggccgcaccuaucgcccuuugaccccgaggcu

SEQ ID NO: 2558 - RNA, 110 nt, Oryza sativa
ccgacaaagugauaguaauauuuuucacaaaauucacaucucucaucugguuuauaaacaucaacacagauaugucaauuuuguaaacaguguaacuaucauuuuguaua

SEQ ID NO: 2559 - RNA, 241 nt, Oryza sativa
cgcuccucugccucccgcugcucugcuucgccgugaccgucguccgguuccgccgccggcggcggcugaggauggccgcgaggaaggggaaggcgcccggcugcugcuucgucgacggggaggagcggacgucuccggagaaggaggagggcggcgggagccgcgcggcgcugcugcugcaguaucuggaggaccagauggagcucgucggcggcggcagcggcggcgaggcggaggaggg

SEQ ID NO: 2560 - RNA, 84 nt, Oryza sativa
acagauauaagauacuuuauaauacaacgaaucugaaaaaaaacaugucuggauucguuguacuauaaagugucucguucggug

SEQ ID NO: 2561 - RNA, 82 nt, Oryza sativa
ugcacccacaacccaccauuaagucguguuuuauuuggauaauuacgaccaaugaaacaugaucggaugucuugagcacgca

SEQ ID NO: 2562 - RNA, 81 nt, Oryza sativa
ggauuguaacucaaugagugauuuaucugcuauagguuggcuauauuguuaugguugauaaguccacugguagaacuacug

SEQ ID NO: 2563 - RNA, 194 nt, Oryza sativa
caugggguggauauaccuagggguggauguagaaaguagcaagagugggggccaacgaucuaccgcuuagguagucuaaggaaguaaaaagugucaagggggcauuugcccccacucgcuguaaaauugagugggggccaaggcccccacuucuuacccucuauauccgccccuauacugugucuuaccgagga

SEQ ID NO: 2564 - RNA, 180 nt, Oryza sativa
gacgaggacggguaccgccgccgccgccgccgcgaggacuccgacgagccggacgacgacgaggaggaucccgaggucgagggcgauggccacggagacgcggggaccgcggcgggcgaaggaggagcgcaugagauggacaaggccgccggcggcggcggcgaugggccugaggacgau

SEQ ID NO: 2565 - RNA, 92 nt, Oryza sativa
ggagcgaugguggccgugcuccccuccccucccucucccucccucccagauccgacccaaggugggaggguagccgcggucgccacagcaaa

SEQ ID NO: 2566 - RNA, 125 nt, Oryza sativa
acucagccgccacaucggacaaaaccaggguuaaaaccaccgagagaccuaaaacgaacgguuuuguuagguuuuguuaguagagggacgcccgguaucugguuuugcgauugggggacgauuuu

SEQ ID NO: 2567 - RNA, 81 nt, Oryza sativa
uccggcagcguagaguaccguggaguagacuugaaggaauucuucugggucaguacucccaucguacuucucuguugcucc

SEQ ID NO: 2568 - RNA, 120 nt, Oryza sativa
ugaugugacauaucugcucgugucacgugcccacgagcacucaugaggguugcaggucugcaacacacuuugguuagcugcucguguccgcgugucgcuggagacaugugugcacgaaau

SEQ ID NO: 2569 - RNA, 165 nt, Oryza sativa
gucuacuugacugacugccauguugucuauggggcuaugagcugauacaguagcaaaauuugcuacaggacacucaaagauuguggcauuugcugugagacacccaaaaaucguguauuugcuuauggacacuguaaaaauaugguaauuagcugcuagacacuc

SEQ ID NO: 2570 - RNA, 101 nt, Oryza sativa
aaaucgauuuuuccaagcgggccacuuaagcauuccgccuguaaaauuaaagguauuuucgcagccggaucgcuuaagugguccgccuggauaaaucgauu

SEQ ID NO: 2571 - RNA, 302 nt, Oryza sativa
gcugcggcgcgccgccgccaccguagccgugcgacgcggucgcggcguccaacuccccuccuuuuucucgccgccgccgccgcaucaccgccgcaucgccgccaccgaggagcaaucggcgguggauuugucguccucggugacgagguuagccccgcgccaccacacccgccccacccucgcuggccccgcaccaccacgcccaccccacccucgccgcccucuucuuuagggacgcggccgccggggaguuggacgccgcggccgugcgcacggcuacgguggcgguggcgcgccgcagc

SEQ ID NO: 2572 - RNA, 74 nt, Oryza sativa
caauuuauuuucuguugguuuguccucacaucuuuguacuuguugugguaugaugaacguaauaauaauaauuu

SEQ ID NO: 2573 - RNA, 295 nt, Oryza sativa
gucguuuuauaugcugagaguagauagaguguuagaaguugauuuuuuaugagauaaaacucaaauuccagaaguugaguuuuuuuaggacgaagggaauaucucuggagucgagucgauuuagaccagcgaaaacccauagaacuaccuagucuuuucugacccacgugauacaaccaaccaaucauauauaagggcuuguuaacuuuguagccacuuuuuacccuacuaaaauuugccacauuuguacauuaucaaauuuuaauacuguuggauauguuuaguuuaaaaccuu

SEQ ID NO: 2574 - RNA, 73 nt, Oryza sativa
cugcugccggcggugagcggagugggacuggaggcgucgauggugucuguccauuugcuggcgucgguggaga

SEQ ID NO: 2575 - RNA, 71 nt, Oryza sativa
uacgcguauauaaaguuuguauacguguaugcaaacuuuguauacgcguaugcaaacuuuguauaugcgua

SEQ ID NO: 2576 - RNA, 232 nt, Oryza sativa
gcggaggcgaggcggcagcggcggcgaggugguuggcugggggacgacgucgccccuucucgucucgcgccgccuccucgucucgcguagcugccucgccuugcgccaccagucgcaccuaccaacugccucgccgccgcugcugccucgccucuuccgccgccgcgcucgccuccucgcggcgacguuguccccucgccaaccgccucgccaccgcugccgcucgccuccu

SEQ ID NO: 2577 - RNA, 69 nt, Oryza sativa
auuuugcugggccuaagcacggcauggccugacuggugucaaguccgugucggcauggcccgauaguug

SEQ ID NO: 2578 - RNA, 78 nt, Oryza sativa
ucccgugcggucgacuuaaguggaccgcacggaaaaauuuauuuucacgugcggucuuuuuaaguggaucacacagga

SEQ ID NO: 2579 - RNA, 73 nt, Oryza sativa
cauuacgagcugaguuccccuacgaguguucucaguuagugaggacacucuaggaguggcucacauuguaaau

SEQ ID NO: 2580 - RNA, 104 nt, Oryza sativa
acuuccccuuugugcaugcgguugcguuguccgcauagagaaauagcgauuuucauagaccuuuucguacauacgggccggcuaaccgcaugcaaagaucgauu

SEQ ID NO: 2581 - RNA, 189 nt, Oryza sativa
uaaugccacguccauccccacaacgcaugucguuugucucaaucauggugagagaugcgggcagccaugagcuagccucgaaugcccuccaccaaaacuaacaugcacgacaucuacacaaucuacacaucuacgcacgacaucucaucgagaugaaugacgugcgccauggggauggacgcggcauua

SEQ ID NO: 2582 - RNA, 294 nt, Oryza sativa
ugaaacuugguccaaagugcaaaugaugguaacuauauauguuaagugaaaauauaagucuuaacucuaguccaaugugaaaauuugguaaauaaagguugaccaaagugaaauuuacucuauuuuuaaauuauauacuccuacauaaacuuauuucuccacucuauuuauuauagugaauuacgcuuugggcuacauuuuauuacacaaguuuuacucuggaccacgcuuaaaccuaccuucucacuuugaaccagguaaguuugucauuguugcgguuuggaccaccccgaa

SEQ ID NO: 2583 - RNA, 140 nt, Oryza sativa
accaacauccuagauugcuuucaaggucauuucuuuauggaccccauucccauaaauucaguauccaaagaugguugcuguaucuaugggaauaaggguuccauaacgaaaugaucuuggacgcaaucuaggaguuugcu

SEQ ID NO: 2584 - RNA, 218 nt, Oryza sativa
cuuguucuccuuguguauacuugaagauuuuucucuucauguggcuuccuccauucuugcuccugugcaacaggaccacccaugggacauggaauugaaccaaccacaagcuuuuccuucuuugguuguucaucucccuuuggacccaauauuucaucuuucauuuggugaccaucaugaccauuaguugaaucaucaagaucaaugaauaaagaacu

SEQ ID NO: 2585 - RNA, 108 nt, Oryza sativa
ccuccccauuucuuggccuccucucgcugcuccugcuugugcucugagccccaacugcucaugcucgugcucaaggaggagcacuggaguagccaagagauggagugc

SEQ ID NO: 2586 - RNA, 228 nt, Oryza sativa
accuaagacauuauuuucaugugcaugucugguccauauauuuguuuggaagugguuuagaccucucauggauaggaguacaaucucacuaaaccacacaauguguguaaccauuuugauauaggcuuaacuuggcccuaaaauagucaaaaggaaagaaaggaaagagcagaaacaagaccaacucuauaaauuugagauuuguaugugaaauguaaaaacccuaaa

SEQ ID NO: 2587 - RNA, 303 nt, Oryza sativa
ugucccuucguuuuggcaaugcaaaugaugugacaacaccaauuggguugagauggucacaaguucgcacgcuugucuuuuuuggaccucuccgcuguacaccuucuauugcugaguuuagaguucuucgaguuuugauccuucgauuaucugcugaugaugaugauguaacuuaugaccucucagaaauugcugaguugcuuggauuaaaguaucuguauauugaugcaugccaucugaauauaaggcuaccaaugcagaugcgacaguugcaauauuuggcaaaguuaaaaauagaagcaa

SEQ ID NO: 2588 - RNA, 222 nt, Oryza sativa
guuauuacauucuaggacagaggcaguacuaaaagucuauuaaacuucguacaaaagauacuaagccaccacguggcgcucuaauaauuuagagaaauccaaaaaauuaugagagaaaagcaaaacauccgagaugaaccaccauaccuaaggcagcuaaugugauuuaccaaggucaucacgagugucgcaacaguacugauuugccaaggugaagaugaa

SEQ ID NO: 2589 - RNA, 281 nt, Oryza sativa
ucgauucacgucaccgguggcugccccggaugcugcgcugcacgcccccuccgggcccgagaggcgccggcggcagcggauccaccgcucccgcgccuggcagcaguggagacggaugccggcacggcaagcggcgaagggggaggaagccggcgcggugagcggcgcccggcggcggcggagacggaggccggcgcccagcagcggcggagacagaggccggcggucucaucuacaguagcgccucgcgugugguggcggcuuaucugauuuggaucggc

SEQ ID NO: 2590 - RNA, 90 nt, Oryza sativa
uuauaucuaaauuacuuuuagauuucauuaaauuacaucuuagacauauaaaaguaaauucaauaaaaccuaaaaguaauuuauauauau

SEQ ID NO: 2591 - RNA, 271 nt, Oryza sativa
cgcucucgcuaucucaggugucacucacuccucggaggaagaagaagaagaugcaaaucuugcagaaacgaaacgaaaaagaaaagaagauggggggauuuggguguugauccugcguggagguggagcuacagguugcgcacacaagaggacaggaucuuggcggcguugggugauggcucaauccauuucuuuauaggauuuuuuucucucgggugugugcuggugaugacgaugacgaggaggaggaggaggagaugauaagaguugg

SEQ ID NO: 2592 - RNA, 305 nt, Oryza sativa
cgaugacgaggaggaggaggaggagaugauaagaguuggaaaaucuccgcuuuuugguuggauuuuuuuuggggguuggaacuuggaaaugguaaagggggaggaggaggagggugguuuggugaaguauuuuugugagggcagccaggucguaucuaugccuuuuucuccuccuccaugggugugacaagacaagaacgaaggcaggaggaaggagaaggagaagaugguaugcuugguuggaaccuucucuucgaauuucuauuuucuuucuuguuuguuuuuuuuuuuuuuuuuugcuguuc

SEQ ID NO: 2593 - RNA, 311 nt, Oryza sativa
aaagacauucuaaaaaacugguaauuugcuauaggacacuuucggcucaauugaagggauggauuccaaaaaaaagacgagaaugccccucuggccacaugcuucaaacaugguguuagaguaaaaauuaagaaauuuuccaacucuaaauuuuccauagcccaaaguacaucacuagcauacaccauauuucauuuucacucuaguaucggcucaaaaagcuuuugauccuagggucauucuugucuuuuuugaaaaauuucucucuccgauugagccggaaguguccuccagcaaauuaccauuuuuuu

SEQ ID NO: 2594 - RNA, 107 nt, Oryza sativa
gaaaacaagucugcuguguuaguguugacgaaaaauucgugcucagucaauggugccggaacugucuuuacgcaaacuaagucgacgaacacaacgguuugagagau

SEQ ID NO: 2595 - RNA, 300 nt, Oryza sativa
auuuucauguauuauguuuuuacucuauucauauauuauuagaaagcugaagaucaaauauauucauuugacaccauaucaacaccuaauccagggcuuugacuucguucgaucuagcucauugaauuaguuuauccagggcacgcgaaacgacauaagucauuagcacaagauuaaucgaguauuuaauacuaaaaauuugaaaauagauuuauuuguuuuuuagaaaacuuauauaauaaaaauuauuuuuuaaaguacacaccauuuagcaauucgguaagcauggucaugacaaau

SEQ ID NO: 2596 - RNA, 64 nt, Oryza sativa
accuauaauauauuacagaugccgguuuuuucuuaaaaaccgacacccauaguauaagugucga

SEQ ID NO: 2597 - RNA, 60 nt, Oryza sativa
cguaucuuaguccaacgaaucuagacagucccuuaucuagauucauuggacuaggauaug

SEQ ID NO: 2598 - RNA, 88 nt, Oryza sativa
guuuucgcuggcggacauuuaagagguccgccucgaaaaauagaguauuuuuuaugguggacgucuuaacauggccgccaggaaaaau

SEQ ID NO: 2599 - RNA, 150 nt, Oryza sativa
acuuuuaucauccuugagaagguaucgggagguaccauauuuuauaguguaaaauuuugguaccucuagcuacguacuaaguaccuugaguaccaaaauuuguaauguaaaaucuugguaccucuagauacuuucuuaagaacuauaaaa

SEQ ID NO: 2600 - RNA, 144 nt, Oryza sativa
gccccucacccauaccgccgccgccgcugacaacgaagccugagagccuaccugcggagauggacuucgagcccgagcucaaggcgcugccuccgccuccacuucucgcccugucacagccgcaaguggauggugcagugaggc

SEQ ID NO: 2601 - RNA, 63 nt, Oryza sativa; identical to SEQ ID NO: 2550

SEQ ID NO: 2602 - RNA, 247 nt, Oryza sativa
gugaagaugaugcagagcagucgcgcuugaagcgcuacccaaaaacuugauugcccgcuuacccgugcagguucucaagcggacggaguuucggaggcaccugcucguuccgaucacccgugcacgcgggaugaacagaaccggggaaacagagagacagcgcaggaacagaaggagaguaucgccaaggaacaauaguaggaggaagacacacacuuugagagccucugccuugcguuauauguag

SEQ ID NO: 2603 - RNA, 80 nt, Oryza sativa
cacaacccccuauagucccgguuaugcaaccgagacuacgaaucuaggacgguugaaauaaccgggacuaaaaauggauc

SEQ ID NO: 2604 - RNA, 230 nt, Oryza sativa
ggaucuaaauugaacgguuuuguauaauuuaggggugaagauuucucguauuuccacaaacucgguguaauguugagggacgacaggugaacuuauuucuuuguugaacuauagggggaauaaguucaguuuaggucccuuaauuugucgcccagucuuuuuuucauccucagucuagaaaaccggauacaacacaucccucaacuuauaaaaccgugcagaaaagguac

SEQ ID NO: 2605 - RNA, 310 nt, Oryza sativa
ggaggaugacgagcuguggcuauuaauugguuucaacaugauuuauaaggcaaacgauaaaaaauaacacgaaccucaacuugaggugaaugagccgguuccgugcugcucuuaaccacugugagcucaaagagauccaccuucaaaauaggaaaaucacuuggagaaaugagagaguuuagcugacacuuguuaagauggacagauucuucugcaacgaggaaugggaccucaccuuugggcaucacauccuccaugcguugucuuuuggaauaucugaucacuaccccuugcuuaucuccaacccggg

SEQ ID NO: 2606 - RNA, 164 nt, Oryza sativa
gcuuauacuguuugaucauuugucuuauucaaaaaauuuuagaauuauuauuuauuuuauuugugacuuaauuuauuaucuaaaguacuuuaagcacaauuuuucauuuuuuuuauauuugcaaaaauuuuuuugaauaagacgaguggugaaauaguacgagc

SEQ ID NO: 2607 - RNA, 311 nt, Oryza sativa
ccacacaucaucaugcgggcgaacucgucgaagcagacgaacccgucgccgucgguguccacgccgccgaucaugcggcggcagucgucgacggagcagagcucgucgccgagcgaggcgagcacggcgcggagcuccucggcggagauccucccguccccgucggcgucgaacaccgcgaacgucuccuucagcucgcccucguccgccgcugcggccgcgaucuccuccagcacgagcuccccggcguaauccgccucggcgagcaucgcggccagcuccuccuugcucgacacgauccuccgcagggc

SEQ ID NO: 2608 - RNA, 195 nt, Oryza sativa
gucuccaucucccucucucucuuccgccgccaacgccgccuugugccgucgcccgcucgccccaccgccuccgccuccgcuuuccacucgcgucggcauccccaagcgccucccccaacccuagccgcccccgccucgcgccgccaccuucgcaguggcacagaucgguggaggaguagagggaagggaaugagg

SEQ ID NO: 2609 - RNA, 113 nt, Oryza sativa
gaccuuccgacuuccguuuggcaaugucuacggcucguguccaagcgcaggcgcucgcaggcaagcugcuuucucgugagucgugacagauguuaagggagcagcuucuaacc

SEQ ID NO: 2610 - RNA, 199 nt, Oryza sativa
gagauugguauaggcaugaaauacauucauagcaaaucucaugucuaaacucaaaaucauuugagaaaaaaagacaaaguuugggugaauaguauuauguuacuauucaucuaacauuugucuuuuuuuuuucucucaaaugaaguugaguuuggaauugggauuugguaugaauguauuucauaccuauaccuaucuc

SEQ ID NO: 2611 - RNA, 65 nt, Oryza sativa
auucugauuuuguuagugcauauguaccuacuaguucuacuggucgugugacucaguguuggauu

SEQ ID NO: 2612 - RNA, 301 nt, Oryza sativa
gaguuucaaggaaggaguugauggugggauugggggaagaggaauaagaguuucaaggagggaguugauggugggauugguuaugggaguuacauuuuuaguccccauccucacaucgaauucccuccaagucucacgaauuaacaagccucucccagguaagagauuggugggaauuggaccucuuaauuucccaucccaaacccccucgaauucccaaaucuuucaaccaaacuacagauuuaaacuuccagauaugauaaacucccauuccccaucaccaacucccuccaaccaaaca

SEQ ID NO: 2613 - RNA, 103 nt, Oryza sativa
ccucccucccucucccucggcugcgagcgggaagaagggcggcgacaacagcagcgcgccccuccccucccucaccuugcagauccgguggaggggaggcaug

SEQ ID NO: 2614 - RNA, 263 nt, Oryza sativa
acacgucuuaggcuguguuugcaaccccuucuucccaaccccacucucuaguuuuccgcgcgcacgcuucucaaaugguuaaacgguguguuuuuuuaaaaaaguuucuauaugaaaguuguuaauuuaaaaaaaucauacuaauccauuuuuuuaaaaaaauagcuaauucuuaauuaaucacgcacuaauggaccacuccguuuuccgugcgaagaguaaaaguugccaucuggggcaugcgaacacagccuuagccugau

SEQ ID NO: 2615 - RNA, 74 nt, Oryza sativa
gcuaccaugccaaaauauugguauuacuaaaaccuaggcaaguuuugguagugccaaaauuuugguaauuuuuu

SEQ ID NO: 2616 - RNA, 264 nt, Oryza sativa
uuaauuaguauauuacucccuccguccuuaaauguuugaugccauuaacuuuuuuaaacauguuugaccguucgucuuauucaaaaacuuuuguaaaauauguaaaauuauauaucuacauaaaaguauauuuaacaaugaaucaaaugauaggaaaaaauuuaauaauuacuuaaauuuuuugaauaagacgaacggucaaaccuauuuaaaaaagucaauggcgucaaacauuuagagacggaaggaguaguuaauaauuag

SEQ ID NO: 2617 - RNA, 152 nt, Oryza sativa
aacccauacgucagucacauauagaaaaaauuaagaacauuuuuuucuccucacuuuuuucauuuauuuuucaaaauuaaaaacaucauuuuucuccucacucucucucucuccucuccuuuuauuuuuuuucuaugugacuaacauguaga

SEQ ID NO: 2618 - RNA, 64 nt, Oryza sativa
aaaccaauacugaguuuaaaccuguauauauauguguguccagguucaaacuuaggauugcguc

SEQ ID NO: 2619 - RNA, 308 nt, Oryza sativa
ggaguaccucgcgcucugccuccucaugcuggcgcgcgggcgacgcgacggcgacgacguggcggcgucggcgucggcggcggcggcggcgguggagcaccggugcuccgucugcggcaaggcguucgcguccuaccaggcucucggcggccacaaggccagccaccggaagccgccgccgcccgccauggucgacgacgacgagguggugguggagacgaaaccggcggcuaucgcgacgccguccucgucggcgucgggcgucuccggcggcggcggcgggagggcgcacgagugcaacgugugcg

SEQ ID NO: 2620 - RNA, 66 nt, Oryza sativa
ugaccgcccuuacgccgccggucggaccgccgcgaugcugccggucugaccgccggagagaugccg

SEQ ID NO: 2621 - RNA, 110 nt, Oryza sativa
ucuauucagcuuuugcugcccuuguuuugcauuguauagguauagcaauaugccauucuguaguggcauaccucuacagugcaaaacaaggacaacaagagguggcaaag

SEQ ID NO: 2622 - RNA, 159 nt, Oryza sativa
aaauuagggauagggaauuugcuaggugugaugcggaugcagauuauuuuccaaugccuacaucaccucacucugacuggucagaagaugaaccucuuguugaggauagcaacaugaauuucuuccgcgaugacuuggcaaaugcuuuguuuaauggau

SEQ ID NO: 2623 - RNA, 215 nt, Oryza sativa
uauugugcaacagauguggaucuccaaggcugaauaugacgaaucaggcccagcgauuguccaccggaagugcuucuaaguucuuggucuuauuuauucucaaguucuugccggguuuccaaugagauauauuguugaguuugucuguuugagcagugcugaaucauacauggccauauuagaguuccuguugaugccagguuuguugcuaguau

SEQ ID NO: 2624 - RNA, 95 nt, Oryza sativa
uacauaccgaugagugaggcaacuugagguagacaaagcaaugaaguguauggcuuuggugguaagauugaguagccucguccuccacauuuggg

SEQ ID NO: 2625 - RNA, 82 nt, Oryza sativa; identical to SEQ ID NO: 2561

SEQ ID NO: 2626 - RNA, 312 nt, Oryza sativa
acuacuaccuuuguuuuuuaauacauaauaucguugacuuuuaauuguucgucuuauuaaaaauuuaguguaaauauauaaaauauaaguuaagauuagaguuccuuuaugauaaaauuaacaacucacgauacaacaaacgacauguauauaauuuuuuaauaagauaaauaguuaaucgucacgauaaaaguuaauaacguuguacauuaaaguuuuuuaauguaguauuaacuaauuacguaagaggauugguacaucauaaacaguauacauauaguaaaaaaacgaauggaguauuaauuaccacug

SEQ ID NO: 2627 - RNA, 110 nt, Oryza sativa
ccuccgucccaaaaacgucaaccucguacuagaauuagacucuauguauagauuuguuauaauaugaugugucccaugcuaguacgagguugacuuuuuugggacggagg

SEQ ID NO: 2628 - RNA, 119 nt, Oryza sativa
guaaaccacgagacgaauuuauuaagccuaauuaauccgucauuagcaaauauguauuguagcaucacauuaucaaaucauggcauaauuagccucaaaagauucgucucgcaauuuac

SEQ ID NO: 2629 - RNA, 127 nt, Oryza sativa
uugccucuguuagccaagaauggcuugccuaucuccacuauuugguucaucacuggaacacacuugggguucucagaugguggaugaaauauggaagauggugagccuuccuggcuaagagagugau

SEQ ID NO: 2630 - RNA, 129 nt, Oryza sativa
auugccucuguuagccaagaauggcuugccuaucuccacuauuugguucaucacuggaacacacuugggguucucagaugguggaugaaauauggaagauggugagccuuccuggcuaagagagugauu

SEQ ID NO: 2631 - RNA, 129 nt, Oryza sativa
uugccucuguuagccaagaauggcuugccuaucuccacuauuugguucaucacuggaacacacuugggguucucagaugguggaugaaauauggaagauggugagccuuccuggcuaagagagugauuc

SEQ ID NO: 2632 - RNA, 122 nt, Oryza sativa
cuccccuucgucgccagcgcggccuccuucuccagcuuccucacgcagcggcggcgguggaggagccccggcgacgcgacgggcggcggguggcgggcaggucgagcggcgacggcgccagg

SEQ ID NO: 2633 - RNA, 106 nt, Oryza sativa
aaaaauauagugaccuagaauuggaugugacacaaccucuauuuaaauacauuguacugggauguguacgaugugucucauccaguccuaguuugcaauauuuugg

SEQ ID NO: 2634 - RNA, 122 nt, Oryza sativa
gacgggaucucgaccucgacauccauaucccacuagaacuugcuaccguugccacuaucuuauguuagugacauugauagcgcguucgagugggauacugaugucgaggucgaguucccggc

SEQ ID NO: 2635 - RNA, 62 nt, Oryza sativa
gugggcggcauaagcagccgcacgcgaaaaucggauuuucgcgugcgguugcgccacccgca

SEQ ID NO: 2636 - RNA, 72 nt, Oryza sativa
ugugggucacuuaacaggcccgcacgcaaaaauaacucuauuuucacgugcgagccuccuaaucuaaaagcg

SEQ ID NO: 2637 - RNA, 310 nt, Oryza sativa
uuggguuauugugccaaugggccgaguagaggagggaggugggauggugcuaagucgggcuuucuuuuaaggaacaagucuauuuugcauacuuuuccacauacauaugaaauauauauuacauauaugaauuuuuuuguccaaaaucuuggguauuccacugaauaccuaugaauuaugguaggcccgccccugcgugugagagcccaauagccaccaccgguagcgcaacacgcaacauagagaucacggauaccaccucauccuucucgaaguggcuugucgcagacaacucaaccgccagaagaaa

SEQ ID NO: 2638 - RNA, 103 nt, Oryza sativa
aagcucuucaucaucuucacacuuuugcagcuguaucuaauaccagagcuaauauauugcccugaaaauuaccugcaaauaugagauagauggugauuuguca

SEQ ID NO: 2639 - RNA, 80 nt, Oryza sativa
acauugcuugauguguaucucacucauguuagcauaaaauguggauuuuuauggaugggauuauguuugauggugguguu

SEQ ID NO: 2640 - RNA, 226 nt, Oryza sativa
cuauguggcaugccacguggacgaugacauggcuaaauuuucuuuuccccuuuuuuucuccccaucuuuucucuccuuccucaccucgggugaagaaaaauacggcagaagggagaggaaggaggcaaaguggagaaaaaaaaaggauaaaaagggagaaaaaagaaggaaaaagggagaaaaaauaaaaaaauccaugucaucguccacguagcaugccacauag

SEQ ID NO: 2641 - RNA, 84 nt, Oryza sativa
ccaacccaagaucagguugcugccauguuucugccaccucaaccuauuguugauccaauacagcagcagccgauucagcaacag

SEQ ID NO: 2642 - RNA, 268 nt, Oryza sativa
uacuguagcagcauacucccucugucccauaaagaaguaauuccuagauucccaaugcaaaacuaaagagauagauaaaugaccaaaauaccccuuauuaauagcauauuaguauugaugguuagguagguaaggaguauugaagaaauaaacuuuuucgauuugugaaccaagugugaaugagaagguagaaguugauuuauuuugugacaaaguuugaauuccagaaguugauuuauuuugggacagaacgaguauaacguaaaag

SEQ ID NO: 2643 - RNA, 79 nt, Oryza sativa
guauuccgguugguaauaccaacugggacuaaagaucccggugaucuuuagccccgguuggugcuaccaaccgggacua

SEQ ID NO: 2644 - RNA, 83 nt, Oryza sativa
ggcaguggcgguggcgguggugguaggcgacgccccacacagccacggcgccgucaucagcagcccgccuccucccgcgcacc

SEQ ID NO: 2645 - RNA, 143 nt, Oryza sativa
gaggcgucggucggaccauugucgggucggcagucagaccggccugauggcccggucagaccggccguauggcugcggucagaccggcuagaaggcccggucagaccagccgacuacgaugagcugguaccggcuucggauuu

SEQ ID NO: 2646 - RNA, 155 nt, Oryza sativa
ggaggaggaguuugagaucgaggaguagaggauaagugcgagggauuauauacgacacauugauguuuaaucccgguugguagauaguagggagccagacgcuuuugauccagacuaaaaaugaucuuuagucccgauugguaauaccgacuggg

SEQ ID NO: 2647 - RNA, 301 nt, Oryza sativa
uguguuuguuuugggaauuuuagugaaguugcauauuauuuguaucuuuguugcacuuuguucuauuaaguuguuucguucuguuuugauucuuuguugcauacaucgauuuuugguguugcaauccguauguucgacuauugauuugguugaaacaauuuugaucaagcauugaaacauuuuuucucugcuagugaaacuuucacucauuguugcauauauagauuuuugguguugcaaucgguauguuugacuauugauuuaguugaaauaauuuuucugaaacacugaaacauuuuuc

SEQ ID NO: 2648 - RNA, 211 nt, Oryza sativa
uaggcuacuuugugcauugagaagaugcugcuagaugagauuguuauugacacuaucaucacugauuuugcaucuagaacuguuagaaaaauuguuuuaaaugauuuagagauauuucuuuuaguauuuuaaacuuauuagugugaaauucguuaaugacaaugaguuuuuaaauauuaucuuguauuuuuauggugaauaggggccuuca

SEQ ID NO: 2649 - RNA, 106 nt, Oryza sativa
cuccggggacgcggcagaggcggccggaggcgaaaucguggcggcaacaccacuggacgccggcgaggacgcgucuccggugcuuuacccgcgaaacggagggcug

SEQ ID NO: 2650 - RNA, 72 nt, Oryza sativa
ccggcaccuauaguaccauauaggugucgauucugaugauagaaucgucaccuauaauauuauaggcgccgg

SEQ ID NO: 2651 - RNA, 181 nt, Oryza sativa
gcccuugacgugaccuacaacuuuguaguugauaaguuuuugaauuaaaacuguuuagggucccaaaauauuguugcauguuuauagauuuugaaauuuuaauuuuaaaauuacauuuugggacaaaaaaugacuugaaauaaaaaaaaucaacuauaaaguuguagaucgugucgagggc

SEQ ID NO: 2652 - RNA, 147 nt, Oryza sativa
ccagaauucguugauugacauguaugccaagugcgguugcaucagccaagcucaauucuuguuuacugagacauauccaaaggauacagugucuuauaaugugaugaucauugcuuuugcgcaacauggacaugcaagagaugcauu

SEQ ID NO: 2653 - RNA, 157 nt, Oryza sativa
uggaccaggagcucgacguuuguuaaggccguucuuuccaacccacacaagguuccgcugccugcauuguuccaagagugucuuggacgaaagcaggaaguggaaccuuguuaggguuggaaagaacugccuuaaggaagucgaugcucuagguccg

SEQ ID NO: 2654 - RNA, 142 nt, Oryza sativa
uuuuggugggaugugacacguccuaguacuaugaaucugaauccggauaggggagccuguccagauuaauucguaguacuaggaugugggaccucuguucagauuaauucauaguacuaggaugugucgcauuccaccaaaa

SEQ ID NO: 2655 - RNA, 122 nt, Oryza sativa
gacgggaucucgaccucgacauccauaucccacuagaacuugcuaccguugccacuaucuuauguuagugacauugauagcaaguucgagugggauacugaugucgaggucgaguucccggc

SEQ ID NO: 2656 - RNA, 76 nt, Oryza sativa
auggcugugguggcuagcacgguugguggcaggggucuacauaggugauggcagcagccggccagcacaacuagcg

SEQ ID NO: 2657 - RNA, 132 nt, Oryza sativa
uuuguccacgucaucacgaguuaaaauuuaacucccaguaaaauuuuaacucgugaaauuuuacucccaguaaaauuuuuacuccuaaguaaauuugcaaguuaaauuuuaacuagugaugacguggacgaa

SEQ ID NO: 2658 - RNA, 82 nt, Oryza sativa
ggaagcgugcucaccggagagaagguggcggccggaggagagagccgugccgucaccgucgccuccaggucgcgccacgcgc

SEQ ID NO: 2659 - RNA, 271 nt, Oryza sativa
agucccccccuccuccccuucgacgaccccugccccugcccuuuuccacccuguugcccuccaccucugucgccgucgccgagguucuagcuccaccgcacgcgcccggcaaugggggcccuggcguuagaugcaagguggugucggcgguggucagccgcgaggcggcaccaacgucgaugaggcggcggcggccgcucgguggaaaagaggggaggcggcggcgagcccaugacgaugggguugugaaugcaggagagagaugaguggg

SEQ ID NO: 2660 - RNA, 148 nt, Oryza sativa
uacucccuccgucccauaauauaaaaauuuaggaccggaugggucauuucauacuacaacgaaucuggacggaauauuguccagauuuguuguacuauaaaaugucucauucgguucuagguugcuauauuaugggauggagggagua

SEQ ID NO: 2661 - RNA, 141 nt, Oryza sativa
accaauuuccuagauugcuuucaaggucauuucuuucugaaaccccguucccauaaauucaguauccaaagcugguuguuguaucuauggaaauaaggguuucagaaugaaaugaucuuggacgcaaucuaggaguuugcu

SEQ ID NO: 2662 - RNA, 110 nt, Oryza sativa
aucucgaccucgacauccauaucccacuagaacuugcuaccguugccacuaucuuaugguagugacauugauagcaaguucgagugggauacugaugucgagguugaguu

SEQ ID NO: 2663 - RNA, 144 nt, Oryza sativa
auuugcuccgguccaacaaaaaauaucucgagguaccaguaccgaaucguuuccgaugagcauuuuuagauccaacgaucggaaaugauuugauaccaugaguuagcgguaccucgagauacuuuuuguuggaccaaaacaaau

SEQ ID NO: 2664 - RNA, 63 nt, Oryza sativa
ccgccgccaccaggccggucagaccgcgcauauagcgccggucagaccgccuggccccccagc

SEQ ID NO: 2665 - RNA, 59 nt, Oryza sativa
auaaaccuuggguuugaaucuggacaugcaucauguccagauuuaaacccaauguuugu

SEQ ID NO: 2666 - RNA, 156 nt, Oryza sativa
auaauuugacucccucaacuaucguccgaguauucauauccuccaaccacaaaaccggguauaucgacuccuccaacuaucaaaaccgguguaaacaauaucccugguuuuggcugauauggcgccuacgugacgguuuugaccgagucuuuuccu

SEQ ID NO: 2667 - RNA, 91 nt, Oryza sativa
uuuaggugaaugugacacauucuaguacaacaaauuuggauauaaagcauauccaaauucguuauacuaggaugugucacauccacccaaa

SEQ ID NO: 2668 - RNA, 132 nt, Oryza sativa
ccccucucucucuuucacuuccguucggcgagcggcggcggagggcaagcgggcgagggccggauccccuagugggaggaugaggggaacggcggcgguggcucguggcaguggaaggacgagaggaauggu

SEQ ID NO: 2669 - RNA, 70 nt, Oryza sativa
augugacuuaucuuagugcuaugacuuuagacagauccccuuuccagauucauaguacuagaauaugucg

SEQ ID NO: 2670 - RNA, 247 nt, Oryza sativa
gugaagaugaugcagagcagucgcgcuugaagcgcuacccaaaaacuugaucguccgccuacacgugcagguucucaagcggacggaguuucggaggcaccugcucguuccaaucacccgugcaugcgggaugaacagaaccggggaaacaaagagacagcgcaggaacagaaggagaguaucgccaaggaacaauaguaggaggaagacacacucuuugagagccucugccuugcauuauauguag

SEQ ID NO: 2671 - RNA, 264 nt, Oryza sativa
aaccggaaacaaaucgauuuucagacaugaaaaugauucagcuauauauauucuaucuuugugcagguccagacuucagacaccauugcaaacuucuggcaugcaguuccagauuuguuuuaccugcuugucugaaacugaaagucacugccuguuaacaaagccuacauaugcggcagaucaagacacaugagaaaaaucucacauguguggcaaauucagcaagcauaugguugugcugaaaacgaugugaugauuuuguug

SEQ ID NO: 2672 - RNA, 162 nt, Oryza sativa
auguccaauguuugauuguccguuuuauuuuuaaaaauuuaugaaaaaguaaaaaagaauaguuacacauaaaguacuaaucauguuuuuaucaucuaauaacaauaaaauuacuaaucauaaaaaaauuucaaauaagauaaguggucaaacguuggauau

SEQ ID NO: 2673 - RNA, 189 nt, Oryza sativa
uccguugagauuuggcuugcaacguuugaccacucaucuuauucaaauuacuuuuauaaauauaaaaaacgaaaaguugugcuuaaaguacuguaaauaauaaaguaagucacaaauaaaauaaauaauaauuuuaaauuuuuuugaauaagacgaguggucaaauguugcaagcaaaaacucaaaauc

SEQ ID NO: 2674 - RNA, 90 nt, Oryza sativa
caagcggcggcgccuccgucgagccgccguuccuccuccgguggugacgcugcgaugacgccgcggcgguggcgguggcgguggcagcuc

SEQ ID NO: 2675 - RNA, 133 nt, Oryza sativa
gcgaugacgccgcggcgguggcgguggcgguggcagcucggcuccgguuggucggaguuguggucuggacgaggucgagcuggauguccuugagcaagcggcggucguaggccgcggcggcugggucgcuggc

SEQ ID NO: 2676 - RNA, 110 nt, Oryza sativa
ugguuuacccuauggcggguugguugaaugugacacaucauaguacuauaaaucuaaacaggguauuaggauguguaacauucaaugaaaaccuuucauauuuugagacg

SEQ ID NO: 2677 - RNA, 120 nt, Oryza sativa
uaccuuugucccauaauauggcaaucuaguaccaggugagacauauccuaguacuacaaaucuggacagcuaggauguaucccaucuaguacuagguugcuauauuaugggaaggagaga

SEQ ID NO: 2678 - RNA, 215 nt, Oryza sativa
aauucucauuugacuacucuugucugaaucuaaaauggauugaaccggaacauuuucaugccaucagagauaaacuuauucaauguacguuacguacacaguaguuccgcauacauauaaaguacaacgguacggugguaacaagcaacaaccugacauaaagcaaggguccaauuagacuccuagauucgugagaagccuauugaauagaaaug

SEQ ID NO: 2679 - RNA, 183 nt, Oryza sativa
uccucaauccuccccaaacauuagaauauaugccucaaguaguucaucuugguucaacaagcaaacaaagauccacagagucucaguacuuuaguucauaccuuuugcauauauagacaauauauucacauaagucaaucaucaugagaucauaugcuugaauguuuggaugagauagauaua

SEQ ID NO: 2680 - RNA, 308 nt, Oryza sativa
uccuacauaguuacaugguaucagagcugaaauccuaaaccaaugaauguuuauccagcaccaauccccugcugcuaggagcuguagcucucggggcaguaccuaauccgcugcugaucuguuucuagucaugaaaagcacugugaucuguaagugcuugcugcaugccaugguuuugcccaauucuauggccaucguuggauucgugaccugacagugaugcaauaaucagugauggauuuguguuggcucuacuugggguugaggaucuuagcuguuagcucugauaccauguuaacuguuuagag

SEQ ID NO: 2681 - RNA, 301 nt, Oryza sativa
uuuccuauguccaccauuugguauuagagcugaaauccuaaaccuuugauuguuuguccacaccaauccacugcugcuaggaguuuuagcuccaauggcaguaccuaaucugguacugaucuguuucuuuucaugaaaagaacuuugugaucugcaugccaugguauuccccaagucugucgccuucaacggauuugugacuugacauuaaugccauaaucagcaguauguuuguguuggcucugauugggguuuaggauguuaguuguuagcucugauaccaauuguuggaccuagagac

SEQ ID NO: 2682 - RNA, 75 nt, Oryza sativa
uuaguuguuagcucugauaccaauuguuggaccuagagacuuggcugacgcauuacuauuggagcccaacauguc

SEQ ID NO: 2683 - RNA, 66 nt, Oryza sativa
uuaccgacuuccaaugacgguugugaccguuuccuaugcuccaaccaucaucaggaaggacacuug

SEQ ID NO: 2684 - RNA, 97 nt, Oryza sativa
gaucaaucauucucaacuucuugugcuggaagaugaugggaggaaaccauccuugaaagucguuuuuggauagcugaagaacagagagguuggagaa

SEQ ID NO: 2685 - RNA, 205 nt, Oryza sativa
aucaaaauuguagcccucgacgagaccuacaacuuuguaguugaaaaguuuuugaauuaaaacuguuuagggucccaaaauauuguugcauguuuauagauuuugaaauuuuaauuuuaaaauuacauuuugggacaaaaaaugacuuagaauaaaaaaaaucaacuaaaaaguuguagaucgcguugagggcuacaaguuugau

SEQ ID NO: 2686 - RNA, 244 nt, Oryza sativa
cccacaacagauuuacuuuuaaugucguaacaaguuacuuucuucuuuuuaaguuacuauauguaaauuacuuuuaagcuuuauugaauuuauuuuuauaugucuaagaaguaauuuaaugaaaucuaaaaauaauuuagauauauuauaaaaaaauguaauuuuuuaucuaaaauauaaucauguaaaaucuuguuauaaagauuuaauuguuacgaacauaacgguguaaucggaucauaaa

SEQ ID NO: 2687 - RNA, 66 nt, Oryza sativa
gauuaugaacuaugaagaugugacauccuggcccaauuaggaugaggcauguguggcccauaagag

SEQ ID NO: 2688 - RNA, 112 nt, Oryza sativa
uaagacuuuuuagcauugaccacauucauauauaugucaaugaaucuggacauauauguguguauagauucauuagcaucuauaugaaugugaguaauacuagaaagucuaa

SEQ ID NO: 2689 - RNA, 143 nt, Oryza sativa
ugaucauuucuucauccgacaaagcaguaguaacauuguucacaaaauuuacauaucucucuuauaacuuaugaaacuauaugugagauauguaaauuuuguaaacaauguuacuaucgcuuuguuggaugaagaaaugacca

SEQ ID NO: 2690 - RNA, 62 nt, Oryza sativa
cuucuccuccugggccgccucggcuucgcccggcccaagccgagccgcgccucccacccguu

SEQ ID NO: 2691 - RNA, 21 nt, Oryza sativa
guugcuauauuuugggacgga

SEQ ID NO: 2692 - RNA, 21 nt, Oryza sativa
guugcuauauuuugggacgga

SEQ ID NO: 2693 - RNA, 21 nt, Oryza sativa
auugcuauauuuugggacgga

SEQ ID NO: 2694 - RNA, 21 nt, Oryza sativa
guuguuauauuuugggacgga

SEQ ID NO: 2695 - RNA, 21 nt, Oryza sativa
guugcuauauuuugggaugga

SEQ ID NO: 2696 - RNA, 21 nt, Oryza sativa
auuguuauauuuugggacgga

SEQ ID NO: 2697 - RNA, 21 nt, Oryza sativa
auuguuauauuuugggacgga

SEQ ID NO: 2698 - RNA, 21 nt, Oryza sativa
augcuuauauuuugggacgga

SEQ ID NO: 2699 - RNA, 21 nt, Oryza sativa
auuguuauauuuugggacgga

SEQ ID NO: 2700 - RNA, 21 nt, Oryza sativa
augauuauauuuugggacgga

SEQ ID NO: 2701 - RNA, 21 nt, Oryza sativa
uuugcuauauuuugggaugga

SEQ ID NO: 2702 - RNA, 21 nt, Oryza sativa
uuugcuauauuuugggaugga

SEQ ID NO: 2703 - RNA, 21 nt, Oryza sativa
guugcuauauuaugggacgga

SEQ ID NO: 2704 - RNA, 21 nt, Oryza sativa
aaagcuauauuuugggacgga

SEQ ID NO: 2705 - RNA, 21 nt, Oryza sativa
guuguuauauuuugggaugga

SEQ ID NO: 2706 - RNA, 21 nt, Oryza sativa
guugcuauauuuuggcacgga

SEQ ID NO: 2707 - RNA, 21 nt, Oryza sativa
gcaguuauauuuugggacgga

SEQ ID NO: 2708 - RNA, 21 nt, Oryza sativa
augcuuacauuuugggacgga

SEQ ID NO: 2709 - RNA, 21 nt, Oryza sativa
acaguuauauuuugggacgga

SEQ ID NO: 2710 - RNA, 21 nt, Oryza sativa
auacuuauauuuugggacgga

SEQ ID NO: 2711 - RNA, 21 nt, Oryza sativa
auacuuauauuuugggacgga

SEQ ID NO: 2712 - RNA, 21 nt, Oryza sativa
auacuuauauuuugggacgga

SEQ ID NO: 2713 - RNA, 21 nt, Oryza sativa
guugauuuauuuugggacgga

SEQ ID NO: 2714 - RNA, 21 nt, Oryza sativa
guugguuuauuuugggacgga

SEQ ID NO: 2715 - RNA, 21 nt, Oryza sativa
guugcuauauucuaggacgga

SEQ ID NO: 2716 - RNA, 21 nt, Oryza sativa
auugcuauauuuuggaaugga

SEQ ID NO: 2717 - RNA, 21 nt, Oryza sativa
auugcuauauuuuggaaugga

SEQ ID NO: 2718 - RNA, 21 nt, Oryza sativa
uucccuauauuuagggacgga

SEQ ID NO: 2719 - RNA, 21 nt, Oryza sativa
augcuuauauuuuggaacgga

SEQ ID NO: 2720 - RNA, 21 nt, Oryza sativa
auugcuauauuauaggacgga

SEQ ID NO: 2721 - RNA, 21 nt, Oryza sativa
uugucuuuuuuuugggacgga

SEQ ID NO: 2722 - RNA, 21 nt, Oryza sativa
uuugcuauauuuugagaugga

SEQ ID NO: 2723 - RNA, 21 nt, Oryza sativa
ugcgauauauuuugggacgga

SEQ ID NO: 2724 - RNA, 21 nt, Oryza sativa
augcuuauauuuugagacgga

SEQ ID NO: 2725 - RNA, 21 nt, Oryza sativa
cuguauuuauuuugggacgga

SEQ ID NO: 2726 - RNA, 21 nt, Oryza sativa
uuggcugaauuugggggcgga

SEQ ID NO: 2727 - RNA, 21 nt, Oryza sativa
uuggcugaauuugggggcgga

SEQ ID NO: 2728 - RNA, 21 nt, Oryza sativa
guggcuuuauugugggguggu

SEQ ID NO: 2729 - RNA, 21 nt, Oryza sativa
cugguuaaauugugggaugga

SEQ ID NO: 2730 - RNA, 21 nt, Zea mays
uagccaaggaugagcugccug

SEQ ID NO: 2731 - RNA, 22 nt, Zea mays
cuuagccaagaauggcuugccu

SEQ ID NO: 2732 - RNA, 21 nt, Zea mays
uagccaagcaugauuugcccg

SEQ ID NO: 2733 - RNA, 21 nt, Zea mays
acaggauauuggguauuucuu

SEQ ID NO: 2734 - RNA, 22 nt, Zea mays
ugggcugcauguuugcugggau

SEQ ID NO: 2735 - RNA, 24 nt, Zea mays
ucgacgacgccguuuugcuguggc

SEQ ID NO: 2736 - RNA, 20 nt, Zea mays
cugcugcugcugcuacugcu

SEQ ID NO: 2737 - RNA, 24 nt, Zea mays
cgcgcucacgccacugguugguuc

SEQ ID NO: 2738 - RNA, 23 nt, Zea mays
uugagugaccuguuuugacgacc

SEQ ID NO: 2739 - RNA, 20 nt, Zea mays
cgucuuugccgagugucuua

SEQ ID NO: 2740 - RNA, 21 nt, Zea mays
uauuccuauguuugguguaau

SEQ ID NO: 2741 - RNA, 24 nt, Zea mays
aucucuugauaaauugguguuccc

SEQ ID NO: 2742 - RNA, 24 nt, Zea mays
cgcuguagggggcaccgcugcggc

SEQ ID NO: 2743 - RNA, 24 nt, Zea mays
ccgugcguugcaacgggaguacgc

SEQ ID NO: 2744 - RNA, 22 nt, Zea mays
gcagcccgacggcgacgcccua

SEQ ID NO: 2745 - RNA, 21 nt, Zea mays
ucgucugcgagauuguccagg

SEQ ID NO: 2746 - RNA, 24 nt, Zea mays
caacgaguacggauuuaagcacgu

SEQ ID NO: 2747 - RNA, 20 nt, Zea mays
gaguuggaggcugcuuagau

SEQ ID NO: 2748 - RNA, 22 nt, Zea mays
cuccccgucuccgcugcaggcc

SEQ ID NO: 2749 - RNA, 22 nt, Zea mays
gcgcaacaucgaugacgcggau

SEQ ID NO: 2750 - RNA, 21 nt, Zea mays
aaugauucccuuagugcccac

SEQ ID NO: 2751 - RNA, 20 nt, Zea mays
gcgguaacgguauaguaccc

SEQ ID NO: 2752 - RNA, 22 nt, Zea mays
aaucgauaccacacuacaaaug

SEQ ID NO: 2753 - RNA, 21 nt, Zea mays
cgaccaugccguacuuugucu

SEQ ID NO: 2754 - RNA, 23 nt, Zea mays
gagcugcugcccuguuugguguu

SEQ ID NO: 2755 - RNA, 20 nt, Zea mays
uacacuccaauccacaugga

SEQ ID NO: 2756 - RNA, 21 nt, Zea mays
acacacguggauugcggugaa

SEQ ID NO: 2757 - RNA, 23 nt, Zea mays
ggagccaaguagaauggagucgu

SEQ ID NO: 2758 - RNA, 22 nt, Zea mays
gacaaggagaauacguggucca

SEQ ID NO: 2759 - RNA, 24 nt, Zea mays
aggccuuguucguuugugccggau

SEQ ID NO: 2760 - RNA, 20 nt, Zea mays
guggauugggugggauugag

SEQ ID NO: 2761 - RNA, 24 nt, Zea mays
ggcugugacauaguuagugccaga

SEQ ID NO: 2762 - RNA, 21 nt, Zea mays
gaacuugccgcccugcacggu

SEQ ID NO: 2763 - RNA, 24 nt, Zea mays
guuugugucggauuggugggucgg

SEQ ID NO: 2764 - RNA, 20 nt, Zea mays
uaauccuaaggaaaaaaugg

SEQ ID NO: 2765 - RNA, 20 nt, Zea mays
ggcaauaagguaguguggau

SEQ ID NO: 2766 - RNA, 21 nt, Zea mays
aucgcaagggugagcucacaa

SEQ ID NO: 2767 - RNA, 24 nt, Zea mays
gcguguucuguggcauggcuuugg

SEQ ID NO: 2768 - RNA, 23 nt, Zea mays
gcggaucgagauggcggcgucgg

SEQ ID NO: 2769 - RNA, 21 nt, Zea mays
gccguuggacauaagcuuaug

SEQ ID NO: 2770 - RNA, 24 nt, Zea mays
agcgacuaauaaaaagaaacggag

SEQ ID NO: 2771 - RNA, 22 nt, Zea mays
aagccgccuugacuggacccgg

SEQ ID NO: 2772 - RNA, 24 nt, Zea mays
aauccgacacaaacgaacaaggcc

SEQ ID NO: 2773 - RNA, 24 nt, Zea mays
aggcuugcugaggcaucagauggu

SEQ ID NO: 2774 - RNA, 23 nt, Zea mays
cguccagcucugaggcccacgug

SEQ ID NO: 2775 - RNA, 20 nt, Zea mays
cgcggcuggagcaggaggcg

SEQ ID NO: 2776 - RNA, 20 nt, Zea mays
ccacgcggccacgccacgcc

SEQ ID NO: 2777 - RNA, 21 nt, Zea mays
augaagaaacggcggcggcug

SEQ ID NO: 2778 - RNA, 20 nt, Zea mays
uuguugcuauuguuguuguu

SEQ ID NO: 2779 - RNA, 20 nt, Zea mays
cgccgccgcccuccgcugcc

SEQ ID NO: 2780 - RNA, 24 nt, Zea mays
cucggagucaagagaacgccaacc

SEQ ID NO: 2781 - RNA, 24 nt, Zea mays
gcaacgcacgggcacucaccuagu

SEQ ID NO: 2782 - RNA, 22 nt, Zea mays
uccaacgggcgagcgcaggagc

SEQ ID NO: 2783 - RNA, 21 nt, Zea mays
ccgccuguuugguuggcuucu

SEQ ID NO: 2784 - RNA, 23 nt, Zea mays
cggcggcggcuacggcgguggcg

SEQ ID NO: 2785 - RNA, 24 nt, Zea mays
cagucccccggacacuacuagcag

SEQ ID NO: 2786 - RNA, 21 nt, Zea mays
ggccaguagugugugugugug

SEQ ID NO: 2787 - RNA, 21 nt, Zea mays
ugcgaggggaggcagggaggc

SEQ ID NO: 2788 - RNA, 22 nt, Zea mays
cugccagugcgaccccugcaac

SEQ ID NO: 2789 - RNA, 21 nt, Zea mays
ucauuaccgagagcaggacuu

SEQ ID NO: 2790 - RNA, 20 nt, Zea mays
uuggugcacaugaugcacau

SEQ ID NO: 2791 - RNA, 24 nt, Zea mays
aaggaagaugacagcgcugaagac

SEQ ID NO: 2792 - RNA, 21 nt, Zea mays
caagccuggcgauugcgugcu

SEQ ID NO: 2793 - RNA, 21 nt, Zea mays
uguuaaauccacgguaaagcc

SEQ ID NO: 2794 - RNA, 24 nt, Zea mays
cggcccugacuccuuaacgugcac

SEQ ID NO: 2795 - RNA, 20 nt, Zea mays
gauuuuagccucuucaaucu

SEQ ID NO: 2796 - RNA, 20 nt, Zea mays
aggagccggagccguaggag

SEQ ID NO: 2797 - RNA, 21 nt, Zea mays
cccgaggcaacuuauacggcc

SEQ ID NO: 2798 - RNA, 24 nt, Zea mays
ucauuccuuacaugccacugagug

SEQ ID NO: 2799 - RNA, 24 nt, Zea mays
uggcggccggaucaccaugggcaa

SEQ ID NO: 2800 - RNA, 24 nt, Zea mays
uguuuggaugucacugaauuggag

SEQ ID NO: 2801 - RNA, 20 nt, Zea mays
gagaugaagcucgcaugcca

SEQ ID NO: 2802 - RNA, 22 nt, Zea mays
uggucacuccaaacaccucuga

SEQ ID NO: 2803 - RNA, 22 nt, Zea mays
cgcuuggacauggauuuggugg

SEQ ID NO: 2804 - RNA, 21 nt, Zea mays
acuagagcuaauaguuaguug

SEQ ID NO: 2805 - RNA, 20 nt, Zea mays
aaaucauggcggcaaccacg

SEQ ID NO: 2806 - RNA, 24 nt, Zea mays
cgaacuuaagguuaagaacguggg

SEQ ID NO: 2807 - RNA, 24 nt, Zea mays
uagagcuaauaguuaguuggcuaa

SEQ ID NO: 2808 - RNA, 24 nt, Zea mays
uaaggccuuguucguuuacgucgg

SEQ ID NO: 2809 - RNA, 20 nt, Zea mays
cguacagccgcccaacagua

SEQ ID NO: 2810 - RNA, 20 nt, Zea mays
ucucccuuccuacuucucgc

SEQ ID NO: 2811 - RNA, 23 nt, Zea mays
caaggagaucaagaacggccgcc

SEQ ID NO: 2812 - RNA, 23 nt, Zea mays
cucaauccucuccgauccucccg

SEQ ID NO: 2813 - RNA, 20 nt, Zea mays
ccauaaacaugguaucauuu

SEQ ID NO: 2814 - RNA, 21 nt, Zea mays
gauuggaguggauugaggugg

SEQ ID NO: 2815 - RNA, 20 nt, Zea mays
ugccuggaaugccuggguug

SEQ ID NO: 2816 - RNA, 24 nt, Zea mays
cccgcggccaccccuuccugccua

SEQ ID NO: 2817 - RNA, 24 nt, Zea mays
aauccagcuuguggcgagugacau

SEQ ID NO: 2818 - RNA, 22 nt, Zea mays
uugggaagcuacgaagaacucg

SEQ ID NO: 2819 - RNA, 20 nt, Zea mays
ccaggcggucguggagcugu

SEQ ID NO: 2820 - RNA, 20 nt, Zea mays
gagucaccaggucgcggguu

SEQ ID NO: 2821 - RNA, 21 nt, Zea mays
ccaccacgccggcagguccuc

SEQ ID NO: 2822 - RNA, 21 nt, Zea mays
acgggacgagaugucagacga

SEQ ID NO: 2823 - RNA, 24 nt, Zea mays
ugaacuaucuagcgacaacuaaaa

SEQ ID NO: 2824 - RNA, 24 nt, Zea mays
cauugguaccggcucuagcgacaa

SEQ ID NO: 2825 - RNA, 24 nt, Zea mays
gggcgaaagucucggcgacgguga

SEQ ID NO: 2826 - RNA, 21 nt, Zea mays
cgaccccuucaucaccacgga

SEQ ID NO: 2827 - RNA, 24 nt, Zea mays
ccgccgagacgggcccgcgcacgc

SEQ ID NO: 2828 - RNA, 20 nt, Zea mays
acaagguccaguggugcacc

SEQ ID NO: 2829 - RNA, 21 nt, Zea mays
ccacggcguccggcgacagcg

SEQ ID NO: 2830 - RNA, 20 nt, Zea mays
ugguaggcaccaacugaaga

SEQ ID NO: 2831 - RNA, 23 nt, Zea mays
ucucauaggaaaccgaggccccu

SEQ ID NO: 2832 - RNA, 21 nt, Zea mays
cucagcucgggguuccgccug

SEQ ID NO: 2833 - RNA, 24 nt, Zea mays
aggucuuguucguuugugccggau

SEQ ID NO: 2834 - RNA, 21 nt, Zea mays
cccucaacggagcacgcaguc

SEQ ID NO: 2835 - RNA, 20 nt, Zea mays
uguguuaccucggcgccaau

SEQ ID NO: 2836 - RNA, 21 nt, Zea mays
ucucagaagcauugugcauga

SEQ ID NO: 2837 - RNA, 22 nt, Zea mays
uccaucucaaccucguaugccu

SEQ ID NO: 2838 - RNA, 21 nt, Zea mays
acuaccuaacuugccacacuu

SEQ ID NO: 2839 - RNA, 20 nt, Zea mays
uugcacaggagcuguccggu

SEQ ID NO: 2840 - RNA, 23 nt, Zea mays
agccgguccaugacgcccuccga

SEQ ID NO: 2841 - RNA, 23 nt, Zea mays
ccaguccaggccagcaucaguuu

SEQ ID NO: 2842 - RNA, 23 nt, Zea mays
caaaaccauagggauugaggggg

SEQ ID NO: 2843 - RNA, 21 nt, Zea mays
cgaccccugcaacugcugauc

SEQ ID NO: 2844 - RNA, 24 nt, Zea mays
cgacuaaucgcuacauaucgccga

SEQ ID NO: 2845 - RNA, 21 nt, Zea mays
cgggccaccguggagcuaggc

SEQ ID NO: 2846 - RNA, 21 nt, Zea mays
cugacugcgugguucuugguu

SEQ ID NO: 2847 - RNA, 24 nt, Zea mays
cggcuggacaaccugcgagucggc

SEQ ID NO: 2848 - RNA, 24 nt, Zea mays
agauggagauccaguggucgcggg

SEQ ID NO: 2849 - RNA, 22 nt, Zea mays
cgaccuaccaagaaugagaggc

SEQ ID NO: 2850 - RNA, 24 nt, Zea mays
gaauacuaaauauugauugacgug

SEQ ID NO: 2851 - RNA, 20 nt, Zea mays
cgccggacggaguguagcgc

SEQ ID NO: 2852 - RNA, 21 nt, Zea mays
caagaacggacgccucgccau

SEQ ID NO: 2853 - RNA, 23 nt, Zea mays
agcuacaccaacccacaacuugg

SEQ ID NO: 2854 - RNA, 24 nt, Zea mays
cgcccagcugggcuaccgcuucga

SEQ ID NO: 2855 - RNA, 24 nt, Zea mays
cgcccuggauuuggccuccgccgc

SEQ ID NO: 2856 - RNA, 23 nt, Zea mays
ucaauccgucucauuccuagagu

SEQ ID NO: 2857 - RNA, 24 nt, Zea mays
augcggcgggugcaggugcgcgua

SEQ ID NO: 2858 - RNA, 24 nt, Zea mays
cggcugucccugaucccaguccca

SEQ ID NO: 2859 - RNA, 24 nt, Zea mays
gcgacaacuaaaacgaaacggagg

SEQ ID NO: 2860 - RNA, 22 nt, Zea mays
ucucaauccacauguguugagg

SEQ ID NO: 2861 - RNA, 24 nt, Zea mays
caauccgauguaaacgaacaaggc

SEQ ID NO: 2862 - RNA, 24 nt, Zea mays
gcgccauaaagucaacugggagac

SEQ ID NO: 2863 - RNA, 22 nt, Zea mays
cuugccugugcgggccucccca

SEQ ID NO: 2864 - RNA, 21 nt, Zea mays
aauuagcaggugacaaauauu

SEQ ID NO: 2865 - RNA, 24 nt, Zea mays
agccaaagcggcggcggcgaagug

SEQ ID NO: 2866 - RNA, 24 nt, Zea mays
cggcucaucggccggcgcuucucu

SEQ ID NO: 2867 - RNA, 23 nt, Zea mays
gaaauacgauuucuaguggcggu

SEQ ID NO: 2868 - RNA, 20 nt, Zea mays
ggaggaggaugccgggcugc

SEQ ID NO: 2869 - RNA, 22 nt, Zea mays
agguugcgccggcggugcguga

SEQ ID NO: 2870 - RNA, 22 nt, Zea mays
cacacagcuaguuacaaggccc

SEQ ID NO: 2871 - RNA, 24 nt, Zea mays
agccaguggggguauuuugguggc

SEQ ID NO: 2872 - RNA, 22 nt, Zea mays
auuuaucgccguuuaguucaaa

SEQ ID NO: 2873 - RNA, 24 nt, Zea mays
gacaacuaaaacgaaacggaugga

SEQ ID NO: 2874 - RNA, 21 nt, Zea mays
uccgccaagcugcaucgccuc

SEQ ID NO: 2875 - RNA, 20 nt, Zea mays
cauugccucuccucucgcca

SEQ ID NO: 2876 - RNA, 20 nt, Zea mays
cgccgccuucucgcgcccgc

SEQ ID NO: 2877 - RNA, 21 nt, Zea mays
ccuccgccuucagccuccucu

SEQ ID NO: 2878 - RNA, 24 nt, Zea mays
ccauguagauugggugggauugga

SEQ ID NO: 2879 - RNA, 24 nt, Zea mays
ggcgaggugacgugacgguugcga

SEQ ID NO: 2880 - RNA, 20 nt, Zea mays
agggcauguucgguuacacc

SEQ ID NO: 2881 - RNA, 24 nt, Zea mays
ugggagcaaguggaaugaagggua

SEQ ID NO: 2882 - RNA, 24 nt, Zea mays
ggcggggccuucgucuugucucgu

SEQ ID NO: 2883 - RNA, 23 nt, Zea mays
aguagacaagugugcuccuggug

SEQ ID NO: 2884 - RNA, 20 nt, Zea mays
ccgccgaaacgcgugugcag

SEQ ID NO: 2885 - RNA, 22 nt, Zea mays
cucaacgucaaaacuguccugc

SEQ ID NO: 2886 - RNA, 20 nt, Zea mays
caauuaagcaugcaucaagu

SEQ ID NO: 2887 - RNA, 23 nt, Zea mays
uacggaguuauacguauugauga

SEQ ID NO: 2888 - RNA, 24 nt, Zea mays
aucgcucugaaugcagagaggcgg

SEQ ID NO: 2889 - RNA, 23 nt, Zea mays
aggccuuguucguuugugucgga

SEQ ID NO: 2890 - RNA, 24 nt, Zea mays
gacgacauccgaauugagcagcca

SEQ ID NO: 2891 - RNA, 24 nt, Zea mays
cggaggaggcgaugcggaacgcca

SEQ ID NO: 2892 - RNA, 24 nt, Zea mays
gcugcauauccugaacgcggaccg

SEQ ID NO: 2893 - RNA, 24 nt, Zea mays
ugcguuugguugcaaugacaggac

SEQ ID NO: 2894 - RNA, 21 nt, Zea mays
aaacaaugaacggagcggcuc

SEQ ID NO: 2895 - RNA, 21 nt, Zea mays
caaggaugcaguccaccacaa

SEQ ID NO: 2896 - RNA, 23 nt, Zea mays
aucuacauguguugagguggauu

SEQ ID NO: 2897 - RNA, 24 nt, Zea mays
uauccagcgacuaauaaaaagaaa

SEQ ID NO: 2898 - RNA, 22 nt, Zea mays
ugcguccgguaggccuucucga

SEQ ID NO: 2899 - RNA, 24 nt, Zea mays
gagugcaaaugauaauauuguccc

SEQ ID NO: 2900 - RNA, 24 nt, Zea mays
agcuuuccaugcccucgccucgcu

SEQ ID NO: 2901 - RNA, 23 nt, Zea mays
uugguuaaguaggaaugaugugg

SEQ ID NO: 2902 - RNA, 22 nt, Zea mays
aaggugacgcgcgucagccucg

SEQ ID NO: 2903 - RNA, 24 nt, Zea mays
ggucguggugcugcugggcgccgu

SEQ ID NO: 2904 - RNA, 20 nt, Zea mays
ccaguucuggcucggcggcu

SEQ ID NO: 2905 - RNA, 21 nt, Zea mays
cugcugccuguauggacucgu

SEQ ID NO: 2906 - RNA, 20 nt, Zea mays
agguccauucguuccacccg

SEQ ID NO: 2907 - RNA, 21 nt, Zea mays
ggcucagggcgcucguggagc

SEQ ID NO: 2908 - RNA, 22 nt, Zea mays
cuccccguccgccgagccguug

SEQ ID NO: 2909 - RNA, 21 nt, Zea mays
aaaaaaacacgacuaagggua

SEQ ID NO: 2910 - RNA, 21 nt, Zea mays
gacucacgccucacgcacggu

SEQ ID NO: 2911 - RNA, 24 nt, Zea mays
gcagcaucggauggguagcagcgc

SEQ ID NO: 2912 - RNA, 24 nt, Zea mays
cgaugaaggucaugcagcuggagc

SEQ ID NO: 2913 - RNA, 22 nt, Zea mays
ugcugagacaacauaggcggag

SEQ ID NO: 2914 - RNA, 20 nt, Zea mays
gggcggcgagcucuucgacc

SEQ ID NO: 2915 - RNA, 24 nt, Zea mays
cgcuccagacuggaucucguuguc

SEQ ID NO: 2916 - RNA, 20 nt, Zea mays
ggaggauggucgcaccuugg

SEQ ID NO: 2917 - RNA, 24 nt, Zea mays
uaauccggauauggauugggugaa

SEQ ID NO: 2918 - RNA, 24 nt, Zea mays
agauccaggacagucgacaaagua

SEQ ID NO: 2919 - RNA, 21 nt, Zea mays
ucuuccuccgcauauaagccu

SEQ ID NO: 2920 - RNA, 24 nt, Zea mays
ccggcgaacucuagccgcggccac

SEQ ID NO: 2921 - RNA, 24 nt, Zea mays
cgccgaaaauaagccuaaagccgc

SEQ ID NO: 2922 - RNA, 20 nt, Zea mays
gauaguaacugggaugcgcu

SEQ ID NO: 2923 - RNA, 20 nt, Zea mays
ugcggacugcgagugacaug

SEQ ID NO: 2924 - RNA, 22 nt, Zea mays
cgacuucaacggacugcgagac

SEQ ID NO: 2925 - RNA, 21 nt, Zea mays
agcgggggugcggaggagggc

SEQ ID NO: 2926 - RNA, 24 nt, Zea mays
ccauguggauugaaguguauugga

SEQ ID NO: 2927 - RNA, 24 nt, Zea mays
acauuaaagcagaccaccaucuuu

SEQ ID NO: 2928 - RNA, 24 nt, Zea mays
cucagacggcuaugcaugugcacc

SEQ ID NO: 2929 - RNA, 21 nt, Zea mays
cgcgcgcgcucguccagccgu

SEQ ID NO: 2930 - RNA, 20 nt, Zea mays
gccaccgccgucgccgccgc

SEQ ID NO: 2931 - RNA, 24 nt, Zea mays
gagcuugacugcgccgucgguggu

SEQ ID NO: 2932 - RNA, 23 nt, Zea mays
aagaagccaaggcggccuuauga

SEQ ID NO: 2933 - RNA, 21 nt, Zea mays
cggaggggauuagaggggcua

SEQ ID NO: 2934 - RNA, 22 nt, Zea mays
uucuuugccgagugcuauggcc

SEQ ID NO: 2935 - RNA, 24 nt, Zea mays
aacgacaucgucaauggucaggcu

SEQ ID NO: 2936 - RNA, 24 nt, Zea mays
cgcgcugcuggugccggccgucgc

SEQ ID NO: 2937 - RNA, 23 nt, Zea mays
cgugugcguuuacuuuuaccugu

SEQ ID NO: 2938 - RNA, 24 nt, Zea mays
gaggguagcacucggcaaagcagu

SEQ ID NO: 2939 - RNA, 23 nt, Zea mays
uaaaguggaauaaaugggaggga

SEQ ID NO: 2940 - RNA, 20 nt, Zea mays
guucucgugggugcgauuca

SEQ ID NO: 2941 - RNA, 20 nt, Zea mays
aaccgcgagcuggaggugau

SEQ ID NO: 2942 - RNA, 24 nt, Zea mays
uggcaaacaagguguagagaugac

SEQ ID NO: 2943 - RNA, 21 nt, Zea mays
acucgguggcggcgcacguua

SEQ ID NO: 2944 - RNA, 20 nt, Zea mays
cccuugaagaaaacacugug

SEQ ID NO: 2945 - RNA, 24 nt, Zea mays
acguccccacgcgaaccggagucc

SEQ ID NO: 2946 - RNA, 20 nt, Zea mays
cggcgaggugggauggagug

SEQ ID NO: 2947 - RNA, 21 nt, Zea mays
gaagcuacuuugccgaguguc

SEQ ID NO: 2948 - RNA, 22 nt, Zea mays
gcaugccacgucuacacuuccc

SEQ ID NO: 2949 - RNA, 22 nt, Zea mays
gauaugggugacauugaccgaa

SEQ ID NO: 2950 - RNA, 20 nt, Zea mays
aaccaugagcugacugcuga

SEQ ID NO: 2951 - RNA, 21 nt, Zea mays
ggcgaccagcgacucaaacag

SEQ ID NO: 2952 - RNA, 24 nt, Zea mays
ccacuaggggucuguuugguuggu

SEQ ID NO: 2953 - RNA, 21 nt, Zea mays
aauacaaaacggauaguucga

SEQ ID NO: 2954 - RNA, 21 nt, Zea mays
acgucugcaucggcuggccgg

SEQ ID NO: 2955 - RNA, 20 nt, Zea mays
accagacauacuugcuccug

SEQ ID NO: 2956 - RNA, 24 nt, Zea mays
auagcuaggcagcaugcagguggc

SEQ ID NO: 2957 - RNA, 21 nt, Zea mays
ucacuccuauggauguugcuc

SEQ ID NO: 2958 - RNA, 20 nt, Zea mays
cacggcgucacguccacgcu

SEQ ID NO: 2959 - RNA, 24 nt, Zea mays
agcugucuucgggaaucugggcgc

SEQ ID NO: 2960 - RNA, 21 nt, Zea mays
gggcggacugggaacacaugg

SEQ ID NO: 2961 - RNA, 23 nt, Zea mays
ccccccccucuaggugcucucag

SEQ ID NO: 2962 - RNA, 23 nt, Zea mays
ccccucaaucuggcguagugcgc

SEQ ID NO: 2963 - RNA, 23 nt, Zea mays
uccgguacaaccgaacgggcccu

SEQ ID NO: 2964 - RNA, 20 nt, Zea mays
cauaaugaggaaaaccuaga

SEQ ID NO: 2965 - RNA, 22 nt, Zea mays
uggucacagagcggacagcaga

SEQ ID NO: 2966 - RNA, 24 nt, Zea mays
cagaaccuuaaccaaugaguaccu

SEQ ID NO: 2967 - RNA, 24 nt, Zea mays
auguccccguugcaacgcaugagc

SEQ ID NO: 2968 - RNA, 20 nt, Zea mays
uauugaauauuaauuugggc

SEQ ID NO: 2969 - RNA, 20 nt, Zea mays
ccgcggcgccggagcgcagg

SEQ ID NO: 2970 - RNA, 22 nt, Zea mays
gcgccgccguggugaccaccau

SEQ ID NO: 2971 - RNA, 20 nt, Zea mays
cgcaggacuacguggacccg

SEQ ID NO: 2972 - RNA, 21 nt, Zea mays
cgguggcggcuacggcggucg

SEQ ID NO: 2973 - RNA, 24 nt, Zea mays
gcugacugggcuggauguccugac

SEQ ID NO: 2974 - RNA, 20 nt, Zea mays
gagccgcagugguguucacu

SEQ ID NO: 2975 - RNA, 21 nt, Zea mays
cagaagauuccuggagcucgg

SEQ ID NO: 2976 - RNA, 24 nt, Zea mays
ucuccaaugcugaacuugaugccu

SEQ ID NO: 2977 - RNA, 24 nt, Zea mays
gagaggccaguccacggucgccgg

SEQ ID NO: 2978 - RNA, 24 nt, Zea mays
gaggcgcagaucaguccaagcagc

SEQ ID NO: 2979 - RNA, 20 nt, Zea mays
ggacuguuugcugcgguguc

SEQ ID NO: 2980 - RNA, 24 nt, Zea mays
ugagagguauguugaugcugucau

SEQ ID NO: 2981 - RNA, 20 nt, Zea mays
cacacagaugaggacuaaac

SEQ ID NO: 2982 - RNA, 23 nt, Zea mays
cugcaccacgcuguccaucguca

SEQ ID NO: 2983 - RNA, 24 nt, Zea mays
cgcagauccagugguuccaggaca

SEQ ID NO: 2984 - RNA, 24 nt, Zea mays
aggauguccagccccuugugugug

SEQ ID NO: 2985 - RNA, 20 nt, Zea mays
cucccggagguguccaucuc

SEQ ID NO: 2986 - RNA, 21 nt, Zea mays
uccacuccgauccucccgaua

SEQ ID NO: 2987 - RNA, 24 nt, Zea mays
agcaggucgagaaggagguggccg

SEQ ID NO: 2988 - RNA, 20 nt, Zea mays
aggaugagagucuugcaaag

SEQ ID NO: 2989 - RNA, 22 nt, Zea mays
acucauccaaucacacucaauc

SEQ ID NO: 2990 - RNA, 22 nt, Zea mays
acaaagacaggugcaugugggc

SEQ ID NO: 2991 - RNA, 22 nt, Zea mays
gcgcgcuccucgagcccagcag

SEQ ID NO: 2992 - RNA, 24 nt, Zea mays
uuuucacggguacggguuugggac

SEQ ID NO: 2993 - RNA, 21 nt, Zea mays
cucgcuuagaaucaggagcug

SEQ ID NO: 2994 - RNA, 23 nt, Zea mays
aaggaguagacucuggucagcgg

SEQ ID NO: 2995 - RNA, 24 nt, Zea mays
cgguacaaccgaacaggcccuuaa

SEQ ID NO: 2996 - RNA, 20 nt, Zea mays
cgccgggcugcggcuggugg

SEQ ID NO: 2997 - RNA, 21 nt, Zea mays
acggagccggaggugcgggcc

SEQ ID NO: 2998 - RNA, 22 nt, Zea mays
cagcagcucggcucggcucgga

SEQ ID NO: 2999 - RNA, 20 nt, Zea mays
aaaaaaguaaggagugagaa

SEQ ID NO: 3000 - RNA, 21 nt, Zea mays
uccgcggaucucuugccuugc

SEQ ID NO: 3001 - RNA, 21 nt, Zea mays
gcggaggcgcugucgaggccg

SEQ ID NO: 3002 - RNA, 21 nt, Zea mays
cuguucgguuuucacggauug

SEQ ID NO: 3003 - RNA, 24 nt, Zea mays
cgucauguaacaauaaucagugcu

SEQ ID NO: 3004 - RNA, 22 nt, Zea mays
gcgccauggucgugccauagcu

SEQ ID NO: 3005 - RNA, 21 nt, Zea mays
caguccgucuucacgcgcccg

SEQ ID NO: 3006 - RNA, 24 nt, Zea mays
ggacggcuuggugcucauggagga

SEQ ID NO: 3007 - RNA, 21 nt, Zea mays
cagccacguacgcuaccaucu

SEQ ID NO: 3008 - RNA, 22 nt, Zea mays
ugauuagcuggaacgauuccgg

SEQ ID NO: 3009 - RNA, 24 nt, Zea mays
cuccagcaacguccucuaaacggu

SEQ ID NO: 3010 - RNA, 22 nt, Zea mays
guguaccugggccgcccgugga

SEQ ID NO: 3011 - RNA, 24 nt, Zea mays
cccgcagccuccguagcuugccga

SEQ ID NO: 3012 - RNA, 24 nt, Zea mays
uacggucggccauacgguugccau

SEQ ID NO: 3013 - RNA, 20 nt, Zea mays
cgucgguuguccuguggccg

SEQ ID NO: 3014 - RNA, 24 nt, Zea mays
gccagagggacugggccgcgcgaa

SEQ ID NO: 3015 - RNA, 20 nt, Zea mays
agaguucugcucucggcaaa

SEQ ID NO: 3016 - RNA, 24 nt, Zea mays
gacggcgcgcgaguuucuguuggc

SEQ ID NO: 3017 - RNA, 20 nt, Zea mays
gcuggggcagauggugaucg

SEQ ID NO: 3018 - RNA, 23 nt, Zea mays
uaaagagcagguuuacgaaugaa

SEQ ID NO: 3019 - RNA, 24 nt, Zea mays
guaggugggccuaaugacuuggga

SEQ ID NO: 3020 - RNA, 20 nt, Zea mays
uaggucaugaggcaccguug

SEQ ID NO: 3021 - RNA, 24 nt, Zea mays
auccgacggaaacgaacaaggccu

SEQ ID NO: 3022 - RNA, 22 nt, Zea mays
caccaccgguagcaucagcggc

SEQ ID NO: 3023 - RNA, 20 nt, Zea mays
caccggacagucugaugccc

SEQ ID NO: 3024 - RNA, 20 nt, Zea mays
cuacaauagcucugcgaaaa

SEQ ID NO: 3025 - RNA, 21 nt, Zea mays
cgacgacgacuccacuaacgc

SEQ ID NO: 3026 - RNA, 24 nt, Zea mays
gcagauccccgauccggacuccga

SEQ ID NO: 3027 - RNA, 20 nt, Zea mays
gaugauuuaauaugugcacc

SEQ ID NO: 3028 - RNA, 20 nt, Zea mays
uggcgcugcucuggcugcca

SEQ ID NO: 3029 - RNA, 22 nt, Zea mays
agccgaacgcugggugucagau

SEQ ID NO: 3030 - RNA, 22 nt, Zea mays
cacaacugacgaucugugugug

SEQ ID NO: 3031 - RNA, 22 nt, Zea mays
ggcuguccgcggcagaucgugu

SEQ ID NO: 3032 - RNA, 24 nt, Zea mays
agaagcuggagccaaacgcgccgc

SEQ ID NO: 3033 - RNA, 21 nt, Zea mays
cccgggacacccagcugcgca

SEQ ID NO: 3034 - RNA, 20 nt, Zea mays
ccgcauggcaacuccggcgu

SEQ ID NO: 3035 - RNA, 22 nt, Zea mays
ggggaaggcgaacugcugcugc

SEQ ID NO: 3036 - RNA, 23 nt, Zea mays
gacacucgacaaagcguacugug

SEQ ID NO: 3037 - RNA, 21 nt, Zea mays
uguuuggaggcuuucuucuuc

SEQ ID NO: 3038 - RNA, 21 nt, Zea mays
ccugccaccgcgcggccccaa

SEQ ID NO: 3039 - RNA, 21 nt, Zea mays
acucguuuagcucgcgaacca

SEQ ID NO: 3040 - RNA, 24 nt, Zea mays
augcgcaaggcgugacgucgacaa

SEQ ID NO: 3041 - RNA, 24 nt, Zea mays
gaagcaggagcuggagcuuugcca

SEQ ID NO: 3042 - RNA, 21 nt, Zea mays
augguguucccaaacuagccc

SEQ ID NO: 3043 - RNA, 21 nt, Zea mays
uagaacagacgacaaauucgu

SEQ ID NO: 3044 - RNA, 24 nt, Zea mays
ccguguguccgugacgguggugga

SEQ ID NO: 3045 - RNA, 20 nt, Zea mays
gccacgucgccugcccacgc

SEQ ID NO: 3046 - RNA, 24 nt, Zea mays
cuuguucguuugugccggauuggu

SEQ ID NO: 3047 - RNA, 23 nt, Zea mays
ggcaucaagguugacaagggcac

SEQ ID NO: 3048 - RNA, 20 nt, Zea mays
uaccucggcgccaaugauga

SEQ ID NO: 3049 - RNA, 21 nt, Zea mays
caguggagcuccucgcgcagu

SEQ ID NO: 3050 - RNA, 24 nt, Zea mays
ggauugaggucaauacuagaguac

SEQ ID NO: 3051 - RNA, 22 nt, Zea mays
uguggcaggggcagcugcgugu

SEQ ID NO: 3052 - RNA, 22 nt, Zea mays
aaaauggaauaaaaucuaggga

SEQ ID NO: 3053 - RNA, 22 nt, Zea mays
caggaguuggcaaugauccacg

SEQ ID NO: 3054 - RNA, 24 nt, Zea mays
gcuuuaggugguuagguagguaag

SEQ ID NO: 3055 - RNA, 23 nt, Zea mays
cagcuccaugcguuagucaacca

SEQ ID NO: 3056 - RNA, 21 nt, Zea mays
ccagccggccacgcgcccacg

SEQ ID NO: 3057 - RNA, 24 nt, Zea mays
ccucauguaccguggugauguggu

SEQ ID NO: 3058 - RNA, 20 nt, Zea mays
gauacccguggccgcgcggu

SEQ ID NO: 3059 - RNA, 24 nt, Zea mays
uguacgcgcugucggagccgcugc

SEQ ID NO: 3060 - RNA, 24 nt, Zea mays
aagauuguaagcagccacgacauc

SEQ ID NO: 3061 - RNA, 24 nt, Zea mays
ucgguuguuccggauuggagcccc

SEQ ID NO: 3062 - RNA, 24 nt, Zea mays
aggccuaguuuggauacuuuggga

SEQ ID NO: 3063 - RNA, 24 nt, Zea mays
cagcguggcggagcaggucgggca

SEQ ID NO: 3064 - RNA, 20 nt, Zea mays
ucgcaaaugcaccucggcag

SEQ ID NO: 3065 - RNA, 20 nt, Zea mays
ugacagaagauagugagcac

SEQ ID NO: 3066 - RNA, 21 nt, Zea mays
cacucgagacugagccaguca

SEQ ID NO: 3067 - RNA, 24 nt, Zea mays
augcaucaucaucuugccggcgcc

SEQ ID NO: 3068 - RNA, 21 nt, Zea mays
caaagcugcucuuuguggucc

SEQ ID NO: 3069 - RNA, 24 nt, Zea mays
aaccgugucggaccuccaaucugu

SEQ ID NO: 3070 - RNA, 24 nt, Zea mays
aacuguagaaagagcauuuucagc

SEQ ID NO: 3071 - RNA, 24 nt, Zea mays
cgugcgccgcgccgugcuguucgu

SEQ ID NO: 3072 - RNA, 23 nt, Zea mays
gcgaggaggccaacgccgaggca

SEQ ID NO: 3073 - RNA, 20 nt, Zea mays
uuccguauuuaguaauuuag

SEQ ID NO: 3074 - RNA, 22 nt, Zea mays
cagcgugauguucaccaagugc

SEQ ID NO: 3075 - RNA, 20 nt, Zea mays
agacguccucuggaaccugg

SEQ ID NO: 3076 - RNA, 24 nt, Zea mays
uccgugcuuccacucucucggcgc

SEQ ID NO: 3077 - RNA, 24 nt, Zea mays
cguggcagcggaaguggaggcgga

SEQ ID NO: 3078 - RNA, 20 nt, Zea mays
cguccguggucugcacgugc

SEQ ID NO: 3079 - RNA, 24 nt, Zea mays
ccacuggcaucgucggcggcgccu

SEQ ID NO: 3080 - RNA, 23 nt, Zea mays
cuacauggagcaucugaugucgg

SEQ ID NO: 3081 - RNA, 20 nt, Zea mays
accugcucaguugccagccg

SEQ ID NO: 3082 - RNA, 24 nt, Zea mays
aaauuggcucauaggacuugguac

SEQ ID NO: 3083 - RNA, 20 nt, Zea mays
ggugcugcaaugucugcucg

SEQ ID NO: 3084 - RNA, 24 nt, Zea mays
acucgacaaaguaccugacaugga

SEQ ID NO: 3085 - RNA, 24 nt, Zea mays
accaccuccaugauuuggcacgcc

SEQ ID NO: 3086 - RNA, 24 nt, Zea mays
ugagcuuccguccgugcuaugggg

SEQ ID NO: 3087 - RNA, 21 nt, Zea mays
ugcaggacgucggcgauggac

SEQ ID NO: 3088 - RNA, 20 nt, Zea mays
gcugcagcgggagacuggug

SEQ ID NO: 3089 - RNA, 24 nt, Zea mays
gaugcagggauguacgaagacaaa

SEQ ID NO: 3090 - RNA, 24 nt, Zea mays
ccggagccguccacgugguggagu

SEQ ID NO: 3091 - RNA, 24 nt, Zea mays
gggcagcgacacagcgcaggaagc

SEQ ID NO: 3092 - RNA, 24 nt, Zea mays
ucccugaugcuucuguuguggcuc

SEQ ID NO: 3093 - RNA, 24 nt, Zea mays
cggaccugccauggauggaagggg

SEQ ID NO: 3094 - RNA, 20 nt, Zea mays
uuuguucccuugcugccggu

SEQ ID NO: 3095 - RNA, 24 nt, Zea mays
cugccauggugcaacuccgucgau

SEQ ID NO: 3096 - RNA, 22 nt, Zea mays
ugagugacauguuggcucuggu

SEQ ID NO: 3097 - RNA, 22 nt, Zea mays
ucgaccacggccggcggcuccu

SEQ ID NO: 3098 - RNA, 21 nt, Zea mays
ugggcugggacggcuggcaga

SEQ ID NO: 3099 - RNA, 21 nt, Zea mays
aaguuaugcaguugcugccuc

SEQ ID NO: 3100 - RNA, 24 nt, Zea mays
uaaagguggugcggaugcuuucug

SEQ ID NO: 3101 - RNA, 22 nt, Zea mays
gauugaaguggauugagaugua

SEQ ID NO: 3102 - RNA, 24 nt, Zea mays
cccauuaggguacggguuuggguc

SEQ ID NO: 3103 - RNA, 20 nt, Zea mays
ccaauccauaugaauugagg

SEQ ID NO: 3104 - RNA, 22 nt, Zea mays
cguccaccucgugcuuccucca

SEQ ID NO: 3105 - RNA, 21 nt, Zea mays
accgacgucuuguggggagcc

SEQ ID NO: 3106 - RNA, 21 nt, Zea mays
auugccaccgcgaugaaugcu

SEQ ID NO: 3107 - RNA, 24 nt, Zea mays
ccgcgcccguccucgacccuccca

SEQ ID NO: 3108 - RNA, 23 nt, Zea mays
gcgucaccggaaggugcugcgcg

SEQ ID NO: 3109 - RNA, 20 nt, Zea mays
gucgcaacgcaugggcacuc

SEQ ID NO: 3110 - RNA, 21 nt, Zea mays
cgacaggaugagcugcucgcg

SEQ ID NO: 3111 - RNA, 24 nt, Zea mays
agcaccacccgaagaugaguagca

SEQ ID NO: 3112 - RNA, 20 nt, Zea mays
ccgcggucgucguggucuuc

SEQ ID NO: 3113 - RNA, 21 nt, Zea mays
gcaccucgcucucaaaaccua

SEQ ID NO: 3114 - RNA, 24 nt, Zea mays
ccggcggguacgccuccuucgccg

SEQ ID NO: 3115 - RNA, 21 nt, Zea mays
agagcuucuuugccgagugcc

SEQ ID NO: 3116 - RNA, 24 nt, Zea mays
aggcaacuccuacacuuaagugca

SEQ ID NO: 3117 - RNA, 24 nt, Zea mays
uaagucgcgcugcaggcguggugu

SEQ ID NO: 3118 - RNA, 20 nt, Zea mays
ugagagaggcuggugcaagu

SEQ ID NO: 3119 - RNA, 20 nt, Zea mays
gccucgacguugccuucggu

SEQ ID NO: 3120 - RNA, 20 nt, Zea mays
aguggccuggggaagagugu

SEQ ID NO: 3121 - RNA, 20 nt, Zea mays
ugccagugaugauuugucug

SEQ ID NO: 3122 - RNA, 22 nt, Zea mays
ucggcgggcggguuggucggca

SEQ ID NO: 3123 - RNA, 20 nt, Zea mays
aguacgcggucuggcuggcg

SEQ ID NO: 3124 - RNA, 21 nt, Zea mays
cggcgaggcccgcgugacgau

SEQ ID NO: 3125 - RNA, 24 nt, Zea mays
gaccguuuagaggacguugcugga

SEQ ID NO: 3126 - RNA, 21 nt, Zea mays
cacacacacagacaagugguu

SEQ ID NO: 3127 - RNA, 22 nt, Zea mays
ccgucgucgaguucgccgcgca

SEQ ID NO: 3128 - RNA, 21 nt, Zea mays
acaacgucgucugaacucugc

SEQ ID NO: 3129 - RNA, 21 nt, Zea mays
uccccggccuucuccagcggc

SEQ ID NO: 3130 - RNA, 21 nt, Zea mays
gagaucgcgcaacaagucccc

SEQ ID NO: 3131 - RNA, 21 nt, Zea mays
gaggacuaccuugagguggac

SEQ ID NO: 3132 - RNA, 20 nt, Zea mays
cgguacgucuugucgagcuc

SEQ ID NO: 3133 - RNA, 21 nt, Zea mays
cccuucucucuucuucgauga

SEQ ID NO: 3134 - RNA, 23 nt, Zea mays
caggggcagagcugcuguugagu

SEQ ID NO: 3135 - RNA, 22 nt, Zea mays
gggcgugccguaugagcugauc

SEQ ID NO: 3136 - RNA, 21 nt, Zea mays
agccuuuggacuacacucggu

SEQ ID NO: 3137 - RNA, 21 nt, Zea mays
uagggugcuguuugguucacg

SEQ ID NO: 3138 - RNA, 21 nt, Zea mays
accagcggccucuccauccuc

SEQ ID NO: 3139 - RNA, 20 nt, Zea mays
cggcgacgguggcgagcgca

SEQ ID NO: 3140 - RNA, 20 nt, Zea mays
aaauuuagaguacguugcug

SEQ ID NO: 3141 - RNA, 21 nt, Zea mays
cugacagcacuaggcaaagaa

SEQ ID NO: 3142 - RNA, 24 nt, Zea mays
guugcaguggguucccaucaagua

SEQ ID NO: 3143 - RNA, 22 nt, Zea mays
uacugccgaugcuccaagcaga

SEQ ID NO: 3144 - RNA, 24 nt, Zea mays
ucccugugaugagcauuuuaguaa

SEQ ID NO: 3145 - RNA, 24 nt, Zea mays
cgacauggcuugggaccaacaguc

SEQ ID NO: 3146 - RNA, 24 nt, Zea mays
auauaaucuagaggguaaacaaac

SEQ ID NO: 3147 - RNA, 20 nt, Zea mays
cagccucuggagccucgacg

SEQ ID NO: 3148 - RNA, 21 nt, Zea mays
gcgaguucuuugccgugccaa

SEQ ID NO: 3149 - RNA, 24 nt, Zea mays
uagaucagaucuacacgucaucaa

SEQ ID NO: 3150 - RNA, 20 nt, Zea mays
aggucgcggacuguccgguc

SEQ ID NO: 3151 - RNA, 21 nt, Zea mays
ucgucgaaguccuggaacucc

SEQ ID NO: 3152 - RNA, 24 nt, Zea mays
cgcggcggagugggcggcgguggu

SEQ ID NO: 3153 - RNA, 20 nt, Zea mays
cucgauuagucggucugguc

SEQ ID NO: 3154 - RNA, 22 nt, Zea mays
ucgcuacaugcugcuacucccu

SEQ ID NO: 3155 - RNA, 21 nt, Zea mays
acagccuuggcaccguacaac

SEQ ID NO: 3156 - RNA, 21 nt, Zea mays
auuccacgagcucaaggcuga

SEQ ID NO: 3157 - RNA, 23 nt, Zea mays
aaauccugcagacaccaccgcuc

SEQ ID NO: 3158 - RNA, 24 nt, Zea mays
ccgcuauccgccuccccucgccgc

SEQ ID NO: 3159 - RNA, 22 nt, Zea mays
ccgaccgcuucuccauguuccc

SEQ ID NO: 3160 - RNA, 20 nt, Zea mays
cgcgagcuguccgggaugac

SEQ ID NO: 3161 - RNA, 20 nt, Zea mays
agggcauuuccgacggccaa

SEQ ID NO: 3162 - RNA, 23 nt, Zea mays
uaggugauaggaguugugugauc

SEQ ID NO: 3163 - RNA, 24 nt, Zea mays
ucggggaggggucucggucaugau

SEQ ID NO: 3164 - RNA, 20 nt, Zea mays
uccuaauggcguucagagca

SEQ ID NO: 3165 - RNA, 22 nt, Zea mays
accgccaccaugccccagaucc

SEQ ID NO: 3166 - RNA, 20 nt, Zea mays
cgccggugcugcugcccuug

SEQ ID NO: 3167 - RNA, 24 nt, Zea mays
aguguucgaugugcaggcugguca

SEQ ID NO: 3168 - RNA, 20 nt, Zea mays
acaagccgaugaagcgagag

SEQ ID NO: 3169 - RNA, 20 nt, Zea mays
cuugauguaucgcucuuggu

SEQ ID NO: 3170 - RNA, 21 nt, Zea mays
aucgccgagggggguagugcc

SEQ ID NO: 3171 - RNA, 24 nt, Zea mays
cgcgaacauggcgauaguuucggu

SEQ ID NO: 3172 - RNA, 22 nt, Zea mays
caccggagcugacugccgcugc

SEQ ID NO: 3173 - RNA, 24 nt, Zea mays
gaggaugaucgugcaagugaugug

SEQ ID NO: 3174 - RNA, 21 nt, Zea mays
ugcucugucgacuguuguuca

SEQ ID NO: 3175 - RNA, 21 nt, Zea mays
ccugcagcgaggucgcggacc

SEQ ID NO: 3176 - RNA, 24 nt, Zea mays
cugaagauugucaucaagaccugu

SEQ ID NO: 3177 - RNA, 23 nt, Zea mays
cggcaagggagcaccagugggcc

SEQ ID NO: 3178 - RNA, 24 nt, Zea mays
gggcaaacgcagaaauccucaggg

SEQ ID NO: 3179 - RNA, 24 nt, Zea mays
ccccuucauuucacuugcucccaa

SEQ ID NO: 3180 - RNA, 20 nt, Zea mays
gccucccacaucugugccgc

SEQ ID NO: 3181 - RNA, 20 nt, Zea mays
cgguccucuguucgucgucg

SEQ ID NO: 3182 - RNA, 23 nt, Zea mays
cugcucugccugcuggugggccc

SEQ ID NO: 3183 - RNA, 21 nt, Zea mays
ugagcgcggcgccgucgagga

SEQ ID NO: 3184 - RNA, 24 nt, Zea mays
agaguagagucccugcaaugaacu

SEQ ID NO: 3185 - RNA, 24 nt, Zea mays
accagugcucguccagcaggucca

SEQ ID NO: 3186 - RNA, 23 nt, Zea mays
aguaacuuugaacugcaugaugu

SEQ ID NO: 3187 - RNA, 20 nt, Zea mays
cgcccccgccgauccgcgcc

SEQ ID NO: 3188 - RNA, 23 nt, Zea mays
ggcgucccgugcuuuuggccaga

SEQ ID NO: 3189 - RNA, 21 nt, Zea mays
ucgcuguguguguuucgaguc

SEQ ID NO: 3190 - RNA, 24 nt, Zea mays
uaagggcuuguucguuuuggugau

SEQ ID NO: 3191 - RNA, 21 nt, Zea mays
agggauucucuauuauggaaa

SEQ ID NO: 3192 - RNA, 24 nt, Zea mays
ggacgaguggggcgggugaugugg

SEQ ID NO: 3193 - RNA, 22 nt, Zea mays
acaccgucuucuccgccaccga

SEQ ID NO: 3194 - RNA, 24 nt, Zea mays
ugguauuaauugggaccgucugau

SEQ ID NO: 3195 - RNA, 22 nt, Zea mays
acgccacugaguacccagagca

SEQ ID NO: 3196 - RNA, 21 nt, Zea mays
cgacgaguggcuggccuggug

SEQ ID NO: 3197 - RNA, 21 nt, Zea mays
cgccuggcaggccgccugggc

SEQ ID NO: 3198 - RNA, 20 nt, Zea mays
auaccuuauaccaccucaau

SEQ ID NO: 3199 - RNA, 23 nt, Zea mays
cuggaggaggucaaauuggaguu

SEQ ID NO: 3200 - RNA, 23 nt, Zea mays
gaaggagcgucuugaugcugaac

SEQ ID NO: 3201 - RNA, 24 nt, Zea mays
aaagaggcuucuuugccgagugcc

SEQ ID NO: 3202 - RNA, 21 nt, Zea mays
gacggccgaguucguggucuc

SEQ ID NO: 3203 - RNA, 23 nt, Zea mays
gcuggucagcugggaugccggga

SEQ ID NO: 3204 - RNA, 24 nt, Zea mays
aaagccagcgaaggcgaagggcgc

SEQ ID NO: 3205 - RNA, 24 nt, Zea mays
ugcggaggcaaucccugucgccug

SEQ ID NO: 3206 - RNA, 20 nt, Zea mays
agccuucuuugccgagugcc

SEQ ID NO: 3207 - RNA, 23 nt, Zea mays
cguugucgagccacauccccuga

SEQ ID NO: 3208 - RNA, 21 nt, Zea mays
agcggugagcaugaccacgaa

SEQ ID NO: 3209 - RNA, 24 nt, Zea mays
ccauccuuggaagacugcucgcgc

SEQ ID NO: 3210 - RNA, 20 nt, Zea mays
gauauuauccugucaggguu

SEQ ID NO: 3211 - RNA, 21 nt, Zea mays
cggcccggacccugucucacc

SEQ ID NO: 3212 - RNA, 23 nt, Zea mays
cacuccucgaugucgaucuccug

SEQ ID NO: 3213 - RNA, 22 nt, Zea mays
gccgguggacagcacaugcgac

SEQ ID NO: 3214 - RNA, 24 nt, Zea mays
accauucauuccuucuuccauggc

SEQ ID NO: 3215 - RNA, 21 nt, Zea mays
gaggcgggucaccagcucaug

SEQ ID NO: 3216 - RNA, 24 nt, Zea mays
aacugacagcagcccgacuuggac

SEQ ID NO: 3217 - RNA, 20 nt, Zea mays
ccugcuggaccgcacggggc

SEQ ID NO: 3218 - RNA, 20 nt, Zea mays
aaagagggcauauaauuggc

SEQ ID NO: 3219 - RNA, 21 nt, Zea mays
gacgaccugaggaccaaccuc

SEQ ID NO: 3220 - RNA, 20 nt, Zea mays
ggacgaggacgacgacggug

SEQ ID NO: 3221 - RNA, 24 nt, Zea mays
agcccacaaaugauaauggcaaaa

SEQ ID NO: 3222 - RNA, 20 nt, Zea mays
uuggcggaaggacgaagagu

SEQ ID NO: 3223 - RNA, 23 nt, Zea mays
aaaccucucaacuaauuuuagcu

SEQ ID NO: 3224 - RNA, 21 nt, Zea mays
guugcuucguuggcucaccgg

SEQ ID NO: 3225 - RNA, 22 nt, Zea mays
ccaacaagcagacucgcagugc

SEQ ID NO: 3226 - RNA, 21 nt, Zea mays
cgccgacgccgacgacgcuga

SEQ ID NO: 3227 - RNA, 21 nt, Zea mays
uuagaugaccaucagcaaaca

SEQ ID NO: 3228 - RNA, 24 nt, Zea mays
acaucugccggucccaugucuuuc

SEQ ID NO: 3229 - RNA, 24 nt, Zea mays
cggcgcgcgccgacguggguguca

SEQ ID NO: 3230 - RNA, 24 nt, Zea mays
ugacuaugaccaucucacaccagc

SEQ ID NO: 3231 - RNA, 22 nt, Zea mays
agccuuagccaaaguguaggac

SEQ ID NO: 3232 - RNA, 24 nt, Zea mays
ggucugggccgcccacaguagggu

SEQ ID NO: 3233 - RNA, 23 nt, Zea mays
uuaaaugcacuagagcuaauagu

SEQ ID NO: 3234 - RNA, 23 nt, Zea mays
cgaacgagccgacgagccgcgag

SEQ ID NO: 3235 - RNA, 23 nt, Zea mays
accagugagcauggagguuuggu

SEQ ID NO: 3236 - RNA, 21 nt, Zea mays
agcagcagcagcagcagaggg

SEQ ID NO: 3237 - RNA, 23 nt, Zea mays
cggugggacuaaaauagggacua

SEQ ID NO: 3238 - RNA, 22 nt, Zea mays
ucgccucccucucgcccgggcg

SEQ ID NO: 3239 - RNA, 24 nt, Zea mays
aguaacacugcucggcgccacagg

SEQ ID NO: 3240 - RNA, 20 nt, Zea mays
ugaggucaaaguaggaugag

SEQ ID NO: 3241 - RNA, 20 nt, Zea mays
uggcgcgcaagcucguggug

SEQ ID NO: 3242 - RNA, 20 nt, Zea mays
uuuggcagaucuauggaacu

SEQ ID NO: 3243 - RNA, 21 nt, Zea mays
aaggagcuguuuggagcuguu

SEQ ID NO: 3244 - RNA, 21 nt, Zea mays
cgacaccaagguccugcaggc

SEQ ID NO: 3245 - RNA, 20 nt, Zea mays
gggcaacguggugcucgugc

SEQ ID NO: 3246 - RNA, 21 nt, Zea mays
agauuugagagugcugccuaa

SEQ ID NO: 3247 - RNA, 24 nt, Zea mays
aggugcucggugggagaagacgug

SEQ ID NO: 3248 - RNA, 22 nt, Zea mays
ggccgcgaggucggagguguuc

SEQ ID NO: 3249 - RNA, 20 nt, Zea mays
ccgcggaggccgucugcgcc

SEQ ID NO: 3250 - RNA, 20 nt, Zea mays
aaggaggugguggagucgcu

SEQ ID NO: 3251 - RNA, 24 nt, Zea mays
uggcguccaccaucaacaggguca

SEQ ID NO: 3252 - RNA, 21 nt, Zea mays
aacguaauggguaaccgauaa

SEQ ID NO: 3253 - RNA, 24 nt, Zea mays
gcgcgugcugguguguguggccga

SEQ ID NO: 3254 - RNA, 23 nt, Zea mays
ugagcucauuaccaagaucgaca

SEQ ID NO: 3255 - RNA, 23 nt, Zea mays
gagaacugcgacugccuccaagg

SEQ ID NO: 3256 - RNA, 21 nt, Zea mays
ccaacgcaacacgaccucggc

SEQ ID NO: 3257 - RNA, 20 nt, Zea mays
cccauggaucccuuugugau

SEQ ID NO: 3258 - RNA, 23 nt, Zea mays
cagcaugguuggacagauggugg

SEQ ID NO: 3259 - RNA, 24 nt, Zea mays
ggccuucuuauaagucuaaguaac

SEQ ID NO: 3260 - RNA, 22 nt, Zea mays
uugaagaacuaaccuuaggcag

SEQ ID NO: 3261 - RNA, 21 nt, Zea mays
gugaaaugaaggacaggagga

SEQ ID NO: 3262 - RNA, 22 nt, Zea mays
uaggccaaaugagauggagucu

SEQ ID NO: 3263 - RNA, 24 nt, Zea mays
ccgacaaaaggcacucggcaaaga

SEQ ID NO: 3264 - RNA, 24 nt, Zea mays
acguguccaacaacagccucgcgg

SEQ ID NO: 3265 - RNA, 20 nt, Zea mays
gccgccggugaggucguaca

SEQ ID NO: 3266 - RNA, 21 nt, Zea mays
aggaccacggcggcgugcacg

SEQ ID NO: 3267 - RNA, 23 nt, Zea mays
gcucgagaacaugugcuggcgga

SEQ ID NO: 3268 - RNA, 20 nt, Zea mays
cgauuaaucgugauuggucc

SEQ ID NO: 3269 - RNA, 20 nt, Zea mays
cagguggcuuucuuucuuga

SEQ ID NO: 3270 - RNA, 20 nt, Zea mays
guccgacacggucaacaggc

SEQ ID NO: 3271 - RNA, 24 nt, Zea mays
auccgacagaaacgaacaaggccu

SEQ ID NO: 3272 - RNA, 24 nt, Zea mays
acgcggcgggcugccggacggagc

SEQ ID NO: 3273 - RNA, 22 nt, Zea mays
ggaugcuggggcgggacugcca

SEQ ID NO: 3274 - RNA, 22 nt, Zea mays
ugugaugaagacauugcaugaa

SEQ ID NO: 3275 - RNA, 20 nt, Zea mays
gggggggggggggggggaau

SEQ ID NO: 3276 - RNA, 21 nt, Zea mays
aaugcacaugaucacugucuu

SEQ ID NO: 3277 - RNA, 24 nt, Zea mays
gagcugcaccgagccgagccgagc

SEQ ID NO: 3278 - RNA, 21 nt, Zea mays
agagcagaugucgcacuacag

SEQ ID NO: 3279 - RNA, 20 nt, Zea mays
ggcgucacagcgaagggugu

SEQ ID NO: 3280 - RNA, 20 nt, Zea mays
cugagggccuuaacauagug

SEQ ID NO: 3281 - RNA, 20 nt, Zea mays
uaaucgugucgugcucgugc

SEQ ID NO: 3282 - RNA, 22 nt, Zea mays
agccgcagaacucgcccgcgga

SEQ ID NO: 3283 - RNA, 21 nt, Zea mays
uugugagggcuucaaagauca

SEQ ID NO: 3284 - RNA, 23 nt, Zea mays
uaccgccguuggucaugcugcua

SEQ ID NO: 3285 - RNA, 22 nt, Zea mays
cgccgccggggccggggccgua

SEQ ID NO: 3286 - RNA, 24 nt, Zea mays
gaggcggccaagcuccucggcgcc

SEQ ID NO: 3287 - RNA, 20 nt, Zea mays
cgccgccaccaccaccgacg

SEQ ID NO: 3288 - RNA, 24 nt, Zea mays
cugccgaagcagccuucugaaaau

SEQ ID NO: 3289 - RNA, 22 nt, Zea mays
ggugcuguuugguucacgaaau

SEQ ID NO: 3290 - RNA, 24 nt, Zea mays
gccgaacacagcgacgcaugcggu

SEQ ID NO: 3291 - RNA, 22 nt, Zea mays
cgccaccgccgccauaaccgcc

SEQ ID NO: 3292 - RNA, 24 nt, Zea mays
ucgucccacggcuuuuucuugagg

SEQ ID NO: 3293 - RNA, 21 nt, Zea mays
ucagcaaggacggcauggcuc

SEQ ID NO: 3294 - RNA, 24 nt, Zea mays
gcgaguagaggccuccgcuuuguc

SEQ ID NO: 3295 - RNA, 22 nt, Zea mays
uggauugagggagauugagggg

SEQ ID NO: 3296 - RNA, 22 nt, Zea mays
augcacauaguaaucuuggaaa

SEQ ID NO: 3297 - RNA, 20 nt, Zea mays
gguuuggucaggcuggagcu

SEQ ID NO: 3298 - RNA, 20 nt, Zea mays
aucgggaaugcaccauggcc

SEQ ID NO: 3299 - RNA, 23 nt, Zea mays
ccgacccaggccgacgccgacga

SEQ ID NO: 3300 - RNA, 23 nt, Zea mays
gaaguguauuuuagggauugaaa

SEQ ID NO: 3301 - RNA, 21 nt, Zea mays
caguugcuugauacuggguuc

SEQ ID NO: 3302 - RNA, 21 nt, Zea mays
aagucacuguuuauugguccu

SEQ ID NO: 3303 - RNA, 24 nt, Zea mays
aagcuucugauugagcaguguugg

SEQ ID NO: 3304 - RNA, 21 nt, Zea mays
cgccagccggcugaccgggau

SEQ ID NO: 3305 - RNA, 24 nt, Zea mays
guggcagguugggcuucagaugga

SEQ ID NO: 3306 - RNA, 24 nt, Zea mays
gcuccgacgagacuggggcgccca

SEQ ID NO: 3307 - RNA, 20 nt, Zea mays
gugacuggugaugugauuug

SEQ ID NO: 3308 - RNA, 20 nt, Zea mays
aaucgauacgacgggguggu

SEQ ID NO: 3309 - RNA, 22 nt, Zea mays
cgcgcaaccgggagcuggaggu

SEQ ID NO: 3310 - RNA, 22 nt, Zea mays
acgcagcaggcgcgccucgucc

SEQ ID NO: 3311 - RNA, 20 nt, Zea mays
ugcaacgguacggggccucc

SEQ ID NO: 3312 - RNA, 24 nt, Zea mays
gugcaguggauguguccgauggca

SEQ ID NO: 3313 - RNA, 21 nt, Zea mays
ccgucgucgcuguccgggccg

SEQ ID NO: 3314 - RNA, 21 nt, Zea mays
ugcgugcucauccucgaggcc

SEQ ID NO: 3315 - RNA, 21 nt, Zea mays
cgaacaggauuacauauugag

SEQ ID NO: 3316 - RNA, 23 nt, Zea mays
agggcuaguuugggagccacaaa

SEQ ID NO: 3317 - RNA, 20 nt, Zea mays
cacgacaacaagcgccuucg

SEQ ID NO: 3318 - RNA, 24 nt, Zea mays
uggucugaagcacagagucuuuga

SEQ ID NO: 3319 - RNA, 21 nt, Zea mays
ccuuggugauuuagcuggcua

SEQ ID NO: 3320 - RNA, 21 nt, Zea mays
gaacaggauaacuuggccgcg

SEQ ID NO: 3321 - RNA, 20 nt, Zea mays
cccggauugauuccuagccg

SEQ ID NO: 3322 - RNA, 24 nt, Zea mays
cacacgacacugcauuuauuccaa

SEQ ID NO: 3323 - RNA, 21 nt, Zea mays
cgcuuccgguugccccacugu

SEQ ID NO: 3324 - RNA, 24 nt, Zea mays
accgaauacagggacuacugacaa

SEQ ID NO: 3325 - RNA, 22 nt, Zea mays
uuccaccagguugacgugguca

SEQ ID NO: 3326 - RNA, 23 nt, Zea mays
cacccguauggucacaaaaacac

SEQ ID NO: 3327 - RNA, 22 nt, Zea mays
ccccaguugcugaggaggacga

SEQ ID NO: 3328 - RNA, 22 nt, Zea mays
ccagagacacagagauagagcc

SEQ ID NO: 3329 - RNA, 24 nt, Zea mays
agcagcuggcguucgggccggggc

SEQ ID NO: 3330 - RNA, 22 nt, Zea mays
gucuucccaccgguggaaacua

SEQ ID NO: 3331 - RNA, 22 nt, Zea mays
uccuggagagguaccugcgggu

SEQ ID NO: 3332 - RNA, 24 nt, Zea mays
ccgugacaagagcauccuccacca

SEQ ID NO: 3333 - RNA, 23 nt, Zea mays
cgagcucuacaaccgcaacgaca

SEQ ID NO: 3334 - RNA, 20 nt, Zea mays
uuuaguugucguuggauagu

SEQ ID NO: 3335 - RNA, 24 nt, Zea mays
ccccagcgccccugagcaugccgu

SEQ ID NO: 3336 - RNA, 20 nt, Zea mays
gagcgucuuccuuugcuggu

SEQ ID NO: 3337 - RNA, 23 nt, Zea mays
cgacaggcacucgucacaggcca

SEQ ID NO: 3338 - RNA, 24 nt, Zea mays
gagcaaccaccuucgucaugccgc

SEQ ID NO: 3339 - RNA, 23 nt, Zea mays
gcuagcucaccggcaggagcgga

SEQ ID NO: 3340 - RNA, 24 nt, Zea mays
gagacaagggcaggugcauguggg

SEQ ID NO: 3341 - RNA, 21 nt, Zea mays
aagcugcugcuguaccugggu

SEQ ID NO: 3342 - RNA, 22 nt, Zea mays
ucucagaugaggagauccuacc

SEQ ID NO: 3343 - RNA, 24 nt, Zea mays
cggcuaccgaggaagcagaagcgc

SEQ ID NO: 3344 - RNA, 22 nt, Zea mays
cuaaaaauuaguaccuagaaac

SEQ ID NO: 3345 - RNA, 24 nt, Zea mays
ugacgucaucucggcgccggaggu

SEQ ID NO: 3346 - RNA, 23 nt, Zea mays
acugaggauggcgaagucaucgg

SEQ ID NO: 3347 - RNA, 21 nt, Zea mays
uuaaguucgacgguguccaug

SEQ ID NO: 3348 - RNA, 21 nt, Zea mays
ucgaucacagggucuucucca

SEQ ID NO: 3349 - RNA, 21 nt, Zea mays
gggcaagagcgcuguagcuua

SEQ ID NO: 3350 - RNA, 23 nt, Zea mays
uacuagaguacccaaacuaggcc

SEQ ID NO: 3351 - RNA, 24 nt, Zea mays
ucgaggacaucgcgcuggaggugg

SEQ ID NO: 3352 - RNA, 21 nt, Zea mays
aggaaaguugcaacgagcuaa

SEQ ID NO: 3353 - RNA, 20 nt, Zea mays
gauuucuacaugcgguuccu

SEQ ID NO: 3354 - RNA, 24 nt, Zea mays
cgcggucgccgugaugauggacac

SEQ ID NO: 3355 - RNA, 23 nt, Zea mays
aauuacucucgauuuguuauagu

SEQ ID NO: 3356 - RNA, 21 nt, Zea mays
cacgucacaaccagcgcggcc

SEQ ID NO: 3357 - RNA, 20 nt, Zea mays
aacaacugaauccgucauuc

SEQ ID NO: 3358 - RNA, 20 nt, Zea mays
aaaaugucaggaccggcccu

SEQ ID NO: 3359 - RNA, 22 nt, Zea mays
cgcggcgacuacgacacgugcg

SEQ ID NO: 3360 - RNA, 20 nt, Zea mays
gagccaugcuaugugaacau

SEQ ID NO: 3361 - RNA, 21 nt, Zea mays
aacuccgugugcugcguauuu

SEQ ID NO: 3362 - RNA, 24 nt, Zea mays
cauguguauugggaauaaccgaac

SEQ ID NO: 3363 - RNA, 20 nt, Zea mays
augacuauggucuuaaaagc

SEQ ID NO: 3364 - RNA, 24 nt, Zea mays
cgguuagcucucaauccaugugga

SEQ ID NO: 3365 - RNA, 22 nt, Zea mays
ucagccggugggacuucgucga

SEQ ID NO: 3366 - RNA, 20 nt, Zea mays
cagggacgaggcagagcaug

SEQ ID NO: 3367 - RNA, 21 nt, Zea mays
augauauccguauccgcacgu

SEQ ID NO: 3368 - RNA, 24 nt, Zea mays
ucgacggcgucgcggaugggcugc

SEQ ID NO: 3369 - RNA, 22 nt, Zea mays
uucaucacaggcuucaacuaca

SEQ ID NO: 3370 - RNA, 24 nt, Zea mays
uagcucggcgccacagaucuuggc

SEQ ID NO: 3371 - RNA, 24 nt, Zea mays
acaugugcuugggcacgagauggu

SEQ ID NO: 3372 - RNA, 23 nt, Zea mays
cgugcugggcauggugcgguccc

SEQ ID NO: 3373 - RNA, 21 nt, Zea mays
ucuggccggcggcguugcccg

SEQ ID NO: 3374 - RNA, 23 nt, Zea mays
aucugugauggcauccucaagcu

SEQ ID NO: 3375 - RNA, 21 nt, Zea mays
gguuuggucugggauggagca

SEQ ID NO: 3376 - RNA, 21 nt, Zea mays
cuuugccgauguacuguucgc

SEQ ID NO: 3377 - RNA, 20 nt, Zea mays
auggauuggacgggauugga

SEQ ID NO: 3378 - RNA, 20 nt, Zea mays
uccgcuucucgcugcugcca

SEQ ID NO: 3379 - RNA, 21 nt, Zea mays
uguuguucgaggccucgugca

SEQ ID NO: 3380 - RNA, 24 nt, Zea mays
accuuugcagagcccgaugagcgc

SEQ ID NO: 3381 - RNA, 24 nt, Zea mays
cuaccagccucccagcgucguccc

SEQ ID NO: 3382 - RNA, 21 nt, Zea mays
acuccaucuccggcgucuccc

SEQ ID NO: 3383 - RNA, 20 nt, Zea mays
gugagacuaguguggcucgu

SEQ ID NO: 3384 - RNA, 24 nt, Zea mays
ugggagcgaauuucaggcuguggu

SEQ ID NO: 3385 - RNA, 21 nt, Zea mays
caaacaucuaugaacuaaacc

SEQ ID NO: 3386 - RNA, 20 nt, Zea mays
gaucucggcacgacguacuc

SEQ ID NO: 3387 - RNA, 20 nt, Zea mays
cauccccaccgugcucaucu

SEQ ID NO: 3388 - RNA, 24 nt, Zea mays
aaacuagcggacgacaaauauuca

SEQ ID NO: 3389 - RNA, 21 nt, Zea mays
auagagggaaacgccacuuca

SEQ ID NO: 3390 - RNA, 23 nt, Zea mays
acgcgaggugccgcccugcgcga

SEQ ID NO: 3391 - RNA, 20 nt, Zea mays
cgcacgaccagcuucggccc

SEQ ID NO: 3392 - RNA, 21 nt, Zea mays
cgaccucgacgcuaccggcuc

SEQ ID NO: 3393 - RNA, 20 nt, Zea mays
guugucaaacuagcccuaaa

SEQ ID NO: 3394 - RNA, 24 nt, Zea mays
acgacauagcacgcugacgacaca

SEQ ID NO: 3395 - RNA, 22 nt, Zea mays
ggacccagcgaggggguggcgg

SEQ ID NO: 3396 - RNA, 22 nt, Zea mays
ucuaccaaagacagaguggccu

SEQ ID NO: 3397 - RNA, 22 nt, Zea mays
gccgaccugaaccaugugucug

SEQ ID NO: 3398 - RNA, 21 nt, Zea mays
gcgacgacggcgggggcgggg

SEQ ID NO: 3399 - RNA, 20 nt, Zea mays
acaaaccaaacauccccuaa

SEQ ID NO: 3400 - RNA, 22 nt, Zea mays
cagaugugcuugccuccuacag

SEQ ID NO: 3401 - RNA, 24 nt, Zea mays
acagcguggguauauggagugucg

SEQ ID NO: 3402 - RNA, 24 nt, Zea mays
cgccucgcucucgcccgcgcugga

SEQ ID NO: 3403 - RNA, 20 nt, Zea mays
ucguuguagcucuggucguc

SEQ ID NO: 3404 - RNA, 24 nt, Zea mays
uaccgucugcaagugaugcguggu

SEQ ID NO: 3405 - RNA, 24 nt, Zea mays
acuccucaaaguccuccauguugc

SEQ ID NO: 3406 - RNA, 22 nt, Zea mays
cucuucgugcugggugauggau

SEQ ID NO: 3407 - RNA, 21 nt, Zea mays
cgguuguaccggaaugagcca

SEQ ID NO: 3408 - RNA, 23 nt, Zea mays
ccggugaggcuccacggauggcg

SEQ ID NO: 3409 - RNA, 20 nt, Zea mays
ugagccgcgucaauaucucc

SEQ ID NO: 3410 - RNA, 22 nt, Zea mays
cgcgagccuucgccgauccgcg

SEQ ID NO: 3411 - RNA, 21 nt, Zea mays
ugucccgcaaccaaacgcacc

SEQ ID NO: 3412 - RNA, 20 nt, Zea mays
ggagcaggggaaaccgugug

SEQ ID NO: 3413 - RNA, 24 nt, Zea mays
cgugaugcccgucggugguuugcu

SEQ ID NO: 3414 - RNA, 21 nt, Zea mays
ccaaacccccucuuuggccca

SEQ ID NO: 3415 - RNA, 24 nt, Zea mays
gagaccgagcgggccgaucuuggg

SEQ ID NO: 3416 - RNA, 24 nt, Zea mays
ggcaaggccucggugucccaccuc

SEQ ID NO: 3417 - RNA, 21 nt, Zea mays
caccguagccgccgccgccac

SEQ ID NO: 3418 - RNA, 23 nt, Zea mays
acgcuaccguacuuguugugcca

SEQ ID NO: 3419 - RNA, 21 nt, Zea mays
acccugucacugcccuuugua

SEQ ID NO: 3420 - RNA, 20 nt, Zea mays
ugggccgaacacgcauggag

SEQ ID NO: 3421 - RNA, 20 nt, Zea mays
auuagcucuagugcauucaa

SEQ ID NO: 3422 - RNA, 20 nt, Zea mays
cgccaacucaucuaaaaaaa

SEQ ID NO: 3423 - RNA, 20 nt, Zea mays
cgugcgugugugcuugucau

SEQ ID NO: 3424 - RNA, 21 nt, Zea mays
ccagccggcugggugggcugc

SEQ ID NO: 3425 - RNA, 23 nt, Zea mays
ucgcauccauccaccacgcaccc

SEQ ID NO: 3426 - RNA, 24 nt, Zea mays
gacgacagcuugucccuggaccgc

SEQ ID NO: 3427 - RNA, 24 nt, Zea mays
agccaaagccccguccaagccgcc

SEQ ID NO: 3428 - RNA, 22 nt, Zea mays
auaaaaaauuggugcacauggu

SEQ ID NO: 3429 - RNA, 21 nt, Zea mays
ccagucccgcggcggccgugg

SEQ ID NO: 3430 - RNA, 20 nt, Zea mays
ucaucaaaauuauggcacua

SEQ ID NO: 3431 - RNA, 24 nt, Zea mays
accaaacaggagcuuagacagagu

SEQ ID NO: 3432 - RNA, 20 nt, Zea mays
uacuaccuccguucucaaau

SEQ ID NO: 3433 - RNA, 24 nt, Zea mays
agcccggguuuugagagcgaguga

SEQ ID NO: 3434 - RNA, 24 nt, Zea mays
ggcuggagcgggggcacggugagg

SEQ ID NO: 3435 - RNA, 24 nt, Zea mays
accaugccuucccaucuacagaca

SEQ ID NO: 3436 - RNA, 24 nt, Zea mays
gacgacgacgacgacgcuggcgcu

SEQ ID NO: 3437 - RNA, 21 nt, Zea mays
aggugggcauacugccaaugg

SEQ ID NO: 3438 - RNA, 20 nt, Zea mays
gagauugaauccccuccuau

SEQ ID NO: 3439 - RNA, 20 nt, Zea mays
cggacucacuccgaauggug

SEQ ID NO: 3440 - RNA, 20 nt, Zea mays
uagagacgucuugggugguc

SEQ ID NO: 3441 - RNA, 24 nt, Zea mays
accgccgucgccgacgcacgacuc

SEQ ID NO: 3442 - RNA, 20 nt, Zea mays
cccuggucagcugaacuccg

SEQ ID NO: 3443 - RNA, 21 nt, Zea mays
cgagccuauacacauuuuucc

SEQ ID NO: 3444 - RNA, 24 nt, Zea mays
cgccugccaguggaugggacggga

SEQ ID NO: 3445 - RNA, 21 nt, Zea mays
agaagcacgaggucauuguug

SEQ ID NO: 3446 - RNA, 24 nt, Zea mays
aaucuccgucggccagcguauagg

SEQ ID NO: 3447 - RNA, 21 nt, Zea mays
uuguucgguugugccuggauc

SEQ ID NO: 3448 - RNA, 24 nt, Zea mays
gagaaggaggacgacgaugcgcga

SEQ ID NO: 3449 - RNA, 21 nt, Zea mays
gaaugggaaugugcuuugcag

SEQ ID NO: 3450 - RNA, 24 nt, Zea mays
cacacgcacaaccuggucccggcu

SEQ ID NO: 3451 - RNA, 20 nt, Zea mays
cauagcacucgguaaagaag

SEQ ID NO: 3452 - RNA, 21 nt, Zea mays
gcgucucauccuaugguaccu

SEQ ID NO: 3453 - RNA, 24 nt, Zea mays
acgcgcuaccuucuaugcuuggua

SEQ ID NO: 3454 - RNA, 21 nt, Zea mays
cuggagacgcgcguggagcua

SEQ ID NO: 3455 - RNA, 20 nt, Zea mays
cagcccccuauuuucagcca

SEQ ID NO: 3456 - RNA, 24 nt, Zea mays
ccaauccaccucaaucccuauggu

SEQ ID NO: 3457 - RNA, 24 nt, Zea mays
acgaaucgaaggcaccaggacgaa

SEQ ID NO: 3458 - RNA, 22 nt, Zea mays
gcauggacuguggaucgaugga

SEQ ID NO: 3459 - RNA, 20 nt, Zea mays
uuagggcuuguucguuuggg

SEQ ID NO: 3460 - RNA, 24 nt, Zea mays
cggcgucaccucccuguuguucuc

SEQ ID NO: 3461 - RNA, 20 nt, Zea mays
auagggauggcaaugggucg

SEQ ID NO: 3462 - RNA, 24 nt, Zea mays
cgcggugcggauggagccgucgug

SEQ ID NO: 3463 - RNA, 24 nt, Zea mays
caaccuucaguaguuagugguggu

SEQ ID NO: 3464 - RNA, 20 nt, Zea mays
gaggggauuggaggggcuaa

SEQ ID NO: 3465 - RNA, 22 nt, Zea mays
ucaaucuauguggauugggugg

SEQ ID NO: 3466 - RNA, 20 nt, Zea mays
gucucacugagucacuaggu

SEQ ID NO: 3467 - RNA, 24 nt, Zea mays
uggauaagaagugugauggggaag

SEQ ID NO: 3468 - RNA, 24 nt, Zea mays
agaaacagacaacacuaccagaaa

SEQ ID NO: 3469 - RNA, 20 nt, Zea mays
ccagcgacagcggguguucg

SEQ ID NO: 3470 - RNA, 22 nt, Zea mays
ggggagcagcgucugguuguca

SEQ ID NO: 3471 - RNA, 22 nt, Zea mays
gacgcgugcauccgcgccuggu

SEQ ID NO: 3472 - RNA, 24 nt, Zea mays
uugguugaauggacaaagagggac

SEQ ID NO: 3473 - RNA, 22 nt, Zea mays
acuggagcugccacuaauguca

SEQ ID NO: 3474 - RNA, 23 nt, Zea mays
ugaacuaaaccgcgacaaauaaa

SEQ ID NO: 3475 - RNA, 20 nt, Zea mays
cuaaugacuugggagguucc

SEQ ID NO: 3476 - RNA, 24 nt, Zea mays
acuucgcgucgucguccacgcugu

SEQ ID NO: 3477 - RNA, 22 nt, Zea mays
agacgccggcgaugcagaagcg

SEQ ID NO: 3478 - RNA, 21 nt, Zea mays
cgcgcagggggggcgucggcg

SEQ ID NO: 3479 - RNA, 22 nt, Zea mays
gcugggugugaagggccugguc

SEQ ID NO: 3480 - RNA, 22 nt, Zea mays
cgugucacacccgguuuuggaa

SEQ ID NO: 3481 - RNA, 21 nt, Zea mays
cgucuaccgcaccauggucgc

SEQ ID NO: 3482 - RNA, 24 nt, Zea mays
cgacggcuguugcagaugguaggu

SEQ ID NO: 3483 - RNA, 23 nt, Zea mays
ucaaaggacgggcccgacuccga

SEQ ID NO: 3484 - RNA, 20 nt, Zea mays
gccaucgccggcgccuccuc

SEQ ID NO: 3485 - RNA, 21 nt, Zea mays
cggccgauuugggcgccacac

SEQ ID NO: 3486 - RNA, 20 nt, Zea mays
augcacugcccgacaucaau

SEQ ID NO: 3487 - RNA, 24 nt, Zea mays
uugggucaugcgcagggguaccuc

SEQ ID NO: 3488 - RNA, 24 nt, Zea mays
gugacgcgggacgagacggugcag

SEQ ID NO: 3489 - RNA, 24 nt, Zea mays
ugggcuugugcaugugcuuggcgu

SEQ ID NO: 3490 - RNA, 22 nt, Zea mays
ugucagaagguacaucuaugca

SEQ ID NO: 3491 - RNA, 20 nt, Zea mays
gacgacgacgacgauggugg

SEQ ID NO: 3492 - RNA, 24 nt, Zea mays
ccagugcaggcgagagcgaggcga

SEQ ID NO: 3493 - RNA, 22 nt, Zea mays
cagaucaagggagagcgguguc

SEQ ID NO: 3494 - RNA, 20 nt, Zea mays
uuugugguagaggggguacg

SEQ ID NO: 3495 - RNA, 24 nt, Zea mays
ccauggauuggaugggauuggaaa

SEQ ID NO: 3496 - RNA, 22 nt, Zea mays
gaagcucggccagccaacugug

SEQ ID NO: 3497 - RNA, 20 nt, Zea mays
gacaaggccugggacgacca

SEQ ID NO: 3498 - RNA, 20 nt, Zea mays
gccguacgaagacgaagucg

SEQ ID NO: 3499 - RNA, 20 nt, Zea mays
gcggcgcagguggucgcgaa

SEQ ID NO: 3500 - RNA, 21 nt, Zea mays
uggauuauauaauuuagaggg

SEQ ID NO: 3501 - RNA, 23 nt, Zea mays
caagucgaccccaagcgcgagcu

SEQ ID NO: 3502 - RNA, 20 nt, Zea mays
aagggcgggccuggugcagc

SEQ ID NO: 3503 - RNA, 21 nt, Zea mays
ugguuuggucaggcuggaucu

SEQ ID NO: 3504 - RNA, 23 nt, Zea mays
cugcgcgucgucgucgaaacccg

SEQ ID NO: 3505 - RNA, 20 nt, Zea mays
cuuuugcgguuuugccuaua

SEQ ID NO: 3506 - RNA, 20 nt, Zea mays
gggggacgaagcaggggcga

SEQ ID NO: 3507 - RNA, 24 nt, Zea mays
aauccggcacaaacgaacaaggcc

SEQ ID NO: 3508 - RNA, 20 nt, Zea mays
uaccacgaggagacgggcau

SEQ ID NO: 3509 - RNA, 24 nt, Zea mays
cagcgagggcgggcuggacuaccu

SEQ ID NO: 3510 - RNA, 23 nt, Zea mays
aaagauggcggacuggguguucg

SEQ ID NO: 3511 - RNA, 21 nt, Zea mays
cgccgcgacccgcacgccguc

SEQ ID NO: 3512 - RNA, 23 nt, Zea mays
cacuccagcaaccgccucgacca

SEQ ID NO: 3513 - RNA, 24 nt, Zea mays
aguugaacaggcucaugaaauaca

SEQ ID NO: 3514 - RNA, 23 nt, Zea mays
caugccucauggucuuggccacu

SEQ ID NO: 3515 - RNA, 23 nt, Zea mays
gaggcacauagagauacgugaca

SEQ ID NO: 3516 - RNA, 24 nt, Zea mays
agaguuuuaguuucuauauuuagu

SEQ ID NO: 3517 - RNA, 24 nt, Zea mays
agaggcgucuuggguggccugccg

SEQ ID NO: 3518 - RNA, 23 nt, Zea mays
agccaaacagcacugcuccugca

SEQ ID NO: 3519 - RNA, 22 nt, Zea mays
ggagcugugccaaacgggcccu

SEQ ID NO: 3520 - RNA, 20 nt, Zea mays
gauucgucuuugccgagugc

SEQ ID NO: 3521 - RNA, 23 nt, Zea mays
ggcugaggggcacuuaugguguc

SEQ ID NO: 3522 - RNA, 24 nt, Zea mays
ccacugcgccggcacguucugugc

SEQ ID NO: 3523 - RNA, 21 nt, Zea mays
accgacaccgccacgaacagc

SEQ ID NO: 3524 - RNA, 22 nt, Zea mays
gguucugcagugaguuggaggg

SEQ ID NO: 3525 - RNA, 21 nt, Zea mays
gggcauguuugguuuguggcu

SEQ ID NO: 3526 - RNA, 20 nt, Zea mays
aaauagaauaagauggaggg

SEQ ID NO: 3527 - RNA, 20 nt, Zea mays
aacgcacaggcacucaccua

SEQ ID NO: 3528 - RNA, 21 nt, Zea mays
guccggccacaugaugggcua

SEQ ID NO: 3529 - RNA, 21 nt, Zea mays
uagccaagaaugacuugccua

SEQ ID NO: 3530 - RNA, 20 nt, Zea mays
gccgagccgguucgcgagcu

SEQ ID NO: 3531 - RNA, 21 nt, Zea mays
uggcaggagguagguagcuua

SEQ ID NO: 3532 - RNA, 20 nt, Zea mays
gcgcugcggggccccgccga

SEQ ID NO: 3533 - RNA, 24 nt, Zea mays
aggaccaucauuauugugcggagg

SEQ ID NO: 3534 - RNA, 22 nt, Zea mays
cgaucggccgaaugauugauug

SEQ ID NO: 3535 - RNA, 24 nt, Zea mays
cgcaguuuugaaaacugaggucca

SEQ ID NO: 3536 - RNA, 23 nt, Zea mays
auuuacaccucaauccaccucaa

SEQ ID NO: 3537 - RNA, 20 nt, Zea mays
gaaucuacuuucagucuagc

SEQ ID NO: 3538 - RNA, 24 nt, Zea mays
acuauccaacgacaacuaaaaaga

SEQ ID NO: 3539 - RNA, 20 nt, Zea mays
aucacgaucuaauggaccag

SEQ ID NO: 3540 - RNA, 24 nt, Zea mays
caauacacauggauuggaugggau

SEQ ID NO: 3541 - RNA, 20 nt, Zea mays
cgacacggugcgccgccugc

SEQ ID NO: 3542 - RNA, 21 nt, Zea mays
cgcguagacgacguccauggc

SEQ ID NO: 3543 - RNA, 22 nt, Zea mays
cucccaagucccaucccaucgc

SEQ ID NO: 3544 - RNA, 20 nt, Zea mays
cggcucgguggucgucggca

SEQ ID NO: 3545 - RNA, 20 nt, Zea mays
gaccaagcacucgcgcuagu

SEQ ID NO: 3546 - RNA, 22 nt, Zea mays
ccgccgugcugcaucggguugu

SEQ ID NO: 3547 - RNA, 21 nt, Zea mays
gggcaucuucuggcaggagga

SEQ ID NO: 3548 - RNA, 24 nt, Zea mays
aacggcugaucucgcuuguggccu

SEQ ID NO: 3549 - RNA, 20 nt, Zea mays
cgucugcaagugaugcgugg

SEQ ID NO: 3550 - RNA, 20 nt, Zea mays
cagcugcuuccauucaacca

SEQ ID NO: 3551 - RNA, 22 nt, Zea mays
aggcaaaguguggcaacuuagg

SEQ ID NO: 3552 - RNA, 21 nt, Zea mays
ucuaugaacuuggucaaacuu

SEQ ID NO: 3553 - RNA, 20 nt, Zea mays
uuagggcuaguuugggagcc

SEQ ID NO: 3554 - RNA, 22 nt, Zea mays
gcacggcacgguggagguccga

SEQ ID NO: 3555 - RNA, 20 nt, Zea mays
ugagcgaggcguguaccaug

SEQ ID NO: 3556 - RNA, 20 nt, Zea mays
ccgaacaaggccuaaagaaa

SEQ ID NO: 3557 - RNA, 24 nt, Zea mays
ggggcugccguccgacgugccgcg

SEQ ID NO: 3558 - RNA, 23 nt, Zea mays
caauacauauggauuggaugaga

SEQ ID NO: 3559 - RNA, 22 nt, Zea mays
gacagagcaaguggugcaggug

SEQ ID NO: 3560 - RNA, 24 nt, Zea mays
cagccaccuggaucccauggacgc

SEQ ID NO: 3561 - RNA, 24 nt, Zea mays
cugcuggaggcauccuauaggguc

SEQ ID NO: 3562 - RNA, 23 nt, Zea mays
cgugggagcuuuggugguuguca

SEQ ID NO: 3563 - RNA, 21 nt, Zea mays
ugccggauuggugggucggaa

SEQ ID NO: 3564 - RNA, 24 nt, Zea mays
auggauuggaugggauuggaaaaa

SEQ ID NO: 3565 - RNA, 20 nt, Zea mays
gccuccccacuucaugccua

SEQ ID NO: 3566 - RNA, 20 nt, Zea mays
cgacggggacggcgccgugg

SEQ ID NO: 3567 - RNA, 22 nt, Zea mays
ucacaugaacauggauagcccg

SEQ ID NO: 3568 - RNA, 20 nt, Zea mays
gguagggcugggcacacgga

SEQ ID NO: 3569 - RNA, 22 nt, Zea mays
cgcuggcaaggaacacgggcgc

SEQ ID NO: 3570 - RNA, 24 nt, Zea mays
ggcaacugugcggucugcggcguc

SEQ ID NO: 3571 - RNA, 21 nt, Zea mays
uucugcaccgacgcgcucgac

SEQ ID NO: 3572 - RNA, 22 nt, Zea mays
guguguacagcgaacggcaugu

SEQ ID NO: 3573 - RNA, 21 nt, Zea mays
cgccgcugcugacgaccaguc

SEQ ID NO: 3574 - RNA, 23 nt, Zea mays
gcaccugucgaggcugccguugg

SEQ ID NO: 3575 - RNA, 24 nt, Zea mays
cgauguaauacgcgauuguuccaa

SEQ ID NO: 3576 - RNA, 21 nt, Zea mays
aggccacugggcucgccauca

SEQ ID NO: 3577 - RNA, 22 nt, Zea mays
gggcaacggugguggcgccaau

SEQ ID NO: 3578 - RNA, 24 nt, Zea mays
cggggagcacgaaguacagcugcc

SEQ ID NO: 3579 - RNA, 20 nt, Zea mays
cgucaauuugaacuugcucg

SEQ ID NO: 3580 - RNA, 21 nt, Zea mays
ugguauuauauacuuugaggu

SEQ ID NO: 3581 - RNA, 24 nt, Zea mays
aagcaaggcugucugcaaguuggu

SEQ ID NO: 3582 - RNA, 24 nt, Zea mays
ucgagcgcccgccguguugugcgc

SEQ ID NO: 3583 - RNA, 22 nt, Zea mays
cacuggcugaggagaacaugcg

SEQ ID NO: 3584 - RNA, 21 nt, Zea mays
cgucgaggaccggcgccgugc

SEQ ID NO: 3585 - RNA, 24 nt, Zea mays
acgauuacacauacgguuggaucu

SEQ ID NO: 3586 - RNA, 21 nt, Zea mays
uccaaacccuagccuagcagc

SEQ ID NO: 3587 - RNA, 20 nt, Zea mays
ugcugcaggagguggcgaau

SEQ ID NO: 3588 - RNA, 24 nt, Zea mays
cgguagaucguacgaugugacgcu

SEQ ID NO: 3589 - RNA, 21 nt, Zea mays
ggugagaggcacgaugcacga

SEQ ID NO: 3590 - RNA, 22 nt, Zea mays
guacggcugaggaggaugcugc

SEQ ID NO: 3591 - RNA, 21 nt, Zea mays
ucgucaucgugcuccgccugg

SEQ ID NO: 3592 - RNA, 23 nt, Zea mays
uucuaagggcuaguuugggaacc

SEQ ID NO: 3593 - RNA, 24 nt, Zea mays
ccaggagaacguggccggggucaa

SEQ ID NO: 3594 - RNA, 24 nt, Zea mays
ccucaacaggggaagcggcgccca

SEQ ID NO: 3595 - RNA, 22 nt, Zea mays
ggccggacaucuccuacgccgu

SEQ ID NO: 3596 - RNA, 23 nt, Zea mays
ucaauccacuccaauccauaugg

SEQ ID NO: 3597 - RNA, 22 nt, Zea mays
acggcgucccggcaccgcuaca

SEQ ID NO: 3598 - RNA, 23 nt, Zea mays
aauaucacaacaucagcuaagcc

SEQ ID NO: 3599 - RNA, 23 nt, Zea mays
ugcagaggcaaccuaagauggac

SEQ ID NO: 3600 - RNA, 21 nt, Zea mays
gaguccugcucucgauaaaca

SEQ ID NO: 3601 - RNA, 20 nt, Zea mays
cgagagauggugaucgugca

SEQ ID NO: 3602 - RNA, 23 nt, Zea mays
acccccgccagucgccucgcgcc

SEQ ID NO: 3603 - RNA, 20 nt, Zea mays
aggucgugcucaugggcgcc

SEQ ID NO: 3604 - RNA, 24 nt, Zea mays
ugcuaccagugaccuacaugcagu

SEQ ID NO: 3605 - RNA, 21 nt, Zea mays
cggcugcaugcggugguuggu

SEQ ID NO: 3606 - RNA, 20 nt, Zea mays
uggaucgugauccauuacca

SEQ ID NO: 3607 - RNA, 20 nt, Zea mays
gaucagaucuguacggugug

SEQ ID NO: 3608 - RNA, 21 nt, Zea mays
ccggcgaccgccguggcugcg

SEQ ID NO: 3609 - RNA, 21 nt, Zea mays
uagaauacccaaacuaggccu

SEQ ID NO: 3610 - RNA, 23 nt, Zea mays
uggccauucuucagggucacccu

SEQ ID NO: 3611 - RNA, 22 nt, Zea mays
aguccugaugcaggagccuguu

SEQ ID NO: 3612 - RNA, 24 nt, Zea mays
ucuugggcggcugcugcuggauga

SEQ ID NO: 3613 - RNA, 21 nt, Zea mays
acggugacggaugaugauguc

SEQ ID NO: 3614 - RNA, 24 nt, Zea mays
gcuucucaacuugguuaaccagcu

SEQ ID NO: 3615 - RNA, 24 nt, Zea mays
gacgacgauucccgguuugagcau

SEQ ID NO: 3616 - RNA, 22 nt, Zea mays
cgggacgggaacgggacaggac

SEQ ID NO: 3617 - RNA, 20 nt, Zea mays
ccucggccgccgccgugccc

SEQ ID NO: 3618 - RNA, 23 nt, Zea mays
gacgagcaagugaccgaggaccc

SEQ ID NO: 3619 - RNA, 21 nt, Zea mays
cggcaaggacuacuuucugug

SEQ ID NO: 3620 - RNA, 22 nt, Zea mays
ucugcugcagcuauaccggcca

SEQ ID NO: 3621 - RNA, 21 nt, Zea mays
uccuggguugauggagggaac

SEQ ID NO: 3622 - RNA, 20 nt, Zea mays
cgcagcuguaauccauagag

SEQ ID NO: 3623 - RNA, 22 nt, Zea mays
ucggcaaagaaccuauaccggu

SEQ ID NO: 3624 - RNA, 20 nt, Zea mays
acacugaagacgccgcccgg

SEQ ID NO: 3625 - RNA, 21 nt, Zea mays
caggaacgcgguggagucguc

SEQ ID NO: 3626 - RNA, 20 nt, Zea mays
ugacgccuggccuaggguuc

SEQ ID NO: 3627 - RNA, 24 nt, Zea mays
ccccucgacaucgagcaccgccga

SEQ ID NO: 3628 - RNA, 21 nt, Zea mays
aagaacuauauuuuagaacgg

SEQ ID NO: 3629 - RNA, 24 nt, Zea mays
gccaacugccauaucuguccccgc

SEQ ID NO: 3630 - RNA, 24 nt, Zea mays
accgcgcgucaugggugccuugcc

SEQ ID NO: 3631 - RNA, 21 nt, Zea mays
guccaccgugcucgacgaccc

SEQ ID NO: 3632 - RNA, 24 nt, Zea mays
cuccuaacccgagaccaaccgaca

SEQ ID NO: 3633 - RNA, 23 nt, Zea mays
guuuuaguugucgcugaauagug

SEQ ID NO: 3634 - RNA, 24 nt, Zea mays
gcccugcuguguugugucaccauc

SEQ ID NO: 3635 - RNA, 24 nt, Zea mays
gacgaugaggaccgucuuauucga

SEQ ID NO: 3636 - RNA, 21 nt, Zea mays
cggcggcuagcuaagaauccu

SEQ ID NO: 3637 - RNA, 20 nt, Zea mays
gaggaggacggcgccgacgg

SEQ ID NO: 3638 - RNA, 21 nt, Zea mays
uggugcuggugcuggugcugc

SEQ ID NO: 3639 - RNA, 22 nt, Zea mays
gugggugcugcugcugcgcgcu

SEQ ID NO: 3640 - RNA, 24 nt, Zea mays
gaacagaagcaaagagccacgugu

SEQ ID NO: 3641 - RNA, 24 nt, Zea mays
ugccgagagccaucuuugccgagu

SEQ ID NO: 3642 - RNA, 20 nt, Zea mays
cgcgcggaugcggccguccg

SEQ ID NO: 3643 - RNA, 23 nt, Zea mays
cgcgcacgggguguucgagugcu

SEQ ID NO: 3644 - RNA, 22 nt, Zea mays
cgcgccgccggccgacuugacg

SEQ ID NO: 3645 - RNA, 23 nt, Zea mays
cucucugcggaggugcggacggu

SEQ ID NO: 3646 - RNA, 24 nt, Zea mays
ccccagaagcugaaccaaacaggg

SEQ ID NO: 3647 - RNA, 21 nt, Zea mays
guucaauaaagcugugggaaa

SEQ ID NO: 3648 - RNA, 21 nt, Zea mays
cucugguuggcgguuggagga

SEQ ID NO: 3649 - RNA, 24 nt, Zea mays
cugguccgugagauugccauccuu

SEQ ID NO: 3650 - RNA, 22 nt, Zea mays
accgccgcaagauggcccgcga

SEQ ID NO: 3651 - RNA, 23 nt, Zea mays
cuccuugaccugauauacuuuag

SEQ ID NO: 3652 - RNA, 24 nt, Zea mays
accgaacgagcagagcagacccuu

SEQ ID NO: 3653 - RNA, 20 nt, Zea mays
guggaucaacgcgugucagg

SEQ ID NO: 3654 - RNA, 24 nt, Zea mays
cgccgagccaucaauugaccucuc

SEQ ID NO: 3655 - RNA, 20 nt, Zea mays
cgccgucgccgaggucgucg

SEQ ID NO: 3656 - RNA, 20 nt, Zea mays
cggagauccugcuggacggc

SEQ ID NO: 3657 - RNA, 21 nt, Zea mays
cgucgcaaacaucgaggaagg

SEQ ID NO: 3658 - RNA, 23 nt, Zea mays
gacgacauggcgacggcggagaa

SEQ ID NO: 3659 - RNA, 24 nt, Zea mays
acuauccagcgauaacuaaaacga

SEQ ID NO: 3660 - RNA, 22 nt, Zea mays
gccacugugacuguaugaagca

SEQ ID NO: 3661 - RNA, 21 nt, Zea mays
uguuguugcagcucaguccuu

SEQ ID NO: 3662 - RNA, 20 nt, Zea mays
ccgcggcugugcauacgccc

SEQ ID NO: 3663 - RNA, 21 nt, Zea mays
cgcagccgcggccgaggccac

SEQ ID NO: 3664 - RNA, 23 nt, Zea mays
ucugaggguuuccuccguccugg

SEQ ID NO: 3665 - RNA, 23 nt, Zea mays
ugggcggugcugcgagguccagc

SEQ ID NO: 3666 - RNA, 21 nt, Zea mays
uggucgacgaugaaggugaag

SEQ ID NO: 3667 - RNA, 22 nt, Zea mays
ggggcugcuuuacaguugugga

SEQ ID NO: 3668 - RNA, 20 nt, Zea mays
gcaacaacggcaagaagguc

SEQ ID NO: 3669 - RNA, 20 nt, Zea mays
ucgcaguggucaguagccgg

SEQ ID NO: 3670 - RNA, 23 nt, Zea mays
cgguuauucccaauacacaugga

SEQ ID NO: 3671 - RNA, 20 nt, Zea mays
cuaacuaacuaugaggaaug

SEQ ID NO: 3672 - RNA, 24 nt, Zea mays
aucgucuguagauuugggguccca

SEQ ID NO: 3673 - RNA, 24 nt, Zea mays
agacgccgucgagggugaagucgc

SEQ ID NO: 3674 - RNA, 24 nt, Zea mays
ggcaugugcagagaaagaaugguc

SEQ ID NO: 3675 - RNA, 20 nt, Zea mays
uccaaggaucuugcugcaua

SEQ ID NO: 3676 - RNA, 22 nt, Zea mays
cgccaggcggaggcaggcaugg

SEQ ID NO: 3677 - RNA, 20 nt, Zea mays
gauuggaugcaccagaucgc

SEQ ID NO: 3678 - RNA, 20 nt, Zea mays
aucgcucggcaggacgaggc

SEQ ID NO: 3679 - RNA, 20 nt, Zea mays
uaagggcuaauuuggugauc

SEQ ID NO: 3680 - RNA, 24 nt, Zea mays
ggccugcgacgagccccgagcggu

SEQ ID NO: 3681 - RNA, 20 nt, Zea mays
agccugcgcuucggcgugcg

SEQ ID NO: 3682 - RNA, 21 nt, Zea mays
ccaacuuagggugugcguaaa

SEQ ID NO: 3683 - RNA, 24 nt, Zea mays
aaccugagaaucagcaaaacagcc

SEQ ID NO: 3684 - RNA, 21 nt, Zea mays
cgcgucccggagccugcccac

SEQ ID NO: 3685 - RNA, 24 nt, Zea mays
ugcugaugcuaccgcugauggagc

SEQ ID NO: 3686 - RNA, 21 nt, Zea mays
uagugcugcuggguuggaugu

SEQ ID NO: 3687 - RNA, 23 nt, Zea mays
ccuaaucugcuaaaaguagccaa

SEQ ID NO: 3688 - RNA, 21 nt, Zea mays
aagcagaagcaguccggcacg

SEQ ID NO: 3689 - RNA, 21 nt, Zea mays
agagcgcgaugauguugcggu

SEQ ID NO: 3690 - RNA, 21 nt, Zea mays
uugagcagcaauuuggauuug

SEQ ID NO: 3691 - RNA, 20 nt, Zea mays
cccccaggacuugcacaccc

SEQ ID NO: 3692 - RNA, 24 nt, Zea mays
ccacaggagacugcgcgucaugga

SEQ ID NO: 3693 - RNA, 24 nt, Zea mays
aagccgaagccgaggaggauggag

SEQ ID NO: 3694 - RNA, 24 nt, Zea mays
cggagcuggagcuggcgcccgcga

SEQ ID NO: 3695 - RNA, 22 nt, Zea mays
cugcucuagcagauaagucucc

SEQ ID NO: 3696 - RNA, 21 nt, Zea mays
cgccgcagcuggacaucgucg

SEQ ID NO: 3697 - RNA, 22 nt, Zea mays
cauccgcaagcugcucgacgaa

SEQ ID NO: 3698 - RNA, 20 nt, Zea mays
cgacggcggcgcgcacuacg

SEQ ID NO: 3699 - RNA, 21 nt, Zea mays
cugcccagauuauauaaccua

SEQ ID NO: 3700 - RNA, 20 nt, Zea mays
gugaagccaggguggaggaa

SEQ ID NO: 3701 - RNA, 23 nt, Zea mays
uauucgagaacggagguaguaga

SEQ ID NO: 3702 - RNA, 24 nt, Zea mays
cgccgcaagcaagccaucgacaac

SEQ ID NO: 3703 - RNA, 24 nt, Zea mays
acucacuugaccuggaugcucuca

SEQ ID NO: 3704 - RNA, 20 nt, Zea mays
ugacaaguuagacagcgaac

SEQ ID NO: 3705 - RNA, 24 nt, Zea mays
caucccugcguuccacacgcgcgu

SEQ ID NO: 3706 - RNA, 21 nt, Zea mays
gggauuccuccccauggaucc

SEQ ID NO: 3707 - RNA, 21 nt, Zea mays
cccccaaccacggaucgcggc

SEQ ID NO: 3708 - RNA, 21 nt, Zea mays
guaguagcugcgguauuagua

SEQ ID NO: 3709 - RNA, 22 nt, Zea mays
agccgcggcgcuuggcgucccg

SEQ ID NO: 3710 - RNA, 24 nt, Zea mays
ggcgaagagcuuguucgaagaugu

SEQ ID NO: 3711 - RNA, 20 nt, Zea mays
gcacgaucgacuuccccgag

SEQ ID NO: 3712 - RNA, 24 nt, Zea mays
gacagucagccgcgugccaugggc

SEQ ID NO: 3713 - RNA, 23 nt, Zea mays
uggcagcagacaaacuggacucc

SEQ ID NO: 3714 - RNA, 23 nt, Zea mays
ccagagcugaucagucacaaaag

SEQ ID NO: 3715 - RNA, 20 nt, Zea mays
auguccucuccaucuaaacc

SEQ ID NO: 3716 - RNA, 21 nt, Zea mays
ugcauacaacugaugaucccu

SEQ ID NO: 3717 - RNA, 24 nt, Zea mays
guaugcaugugcuuguguaugauc

SEQ ID NO: 3718 - RNA, 22 nt, Zea mays
accugcagguggggucuauccu

SEQ ID NO: 3719 - RNA, 24 nt, Zea mays
guggucgccgccgcuggugaggcu

SEQ ID NO: 3720 - RNA, 24 nt, Zea mays
aucuuuuagagcgugcuguaaagg

SEQ ID NO: 3721 - RNA, 20 nt, Zea mays
gacugcuugcugccagaugc

SEQ ID NO: 3722 - RNA, 22 nt, Zea mays
ccgcagcaccugguguucgccu

SEQ ID NO: 3723 - RNA, 24 nt, Zea mays
uggugucacccacaagaugcaguc

SEQ ID NO: 3724 - RNA, 20 nt, Zea mays
cgcucugggccgccgccgcc

SEQ ID NO: 3725 - RNA, 22 nt, Zea mays
ggcuuguucgguuagaggugga

SEQ ID NO: 3726 - RNA, 21 nt, Zea mays
uucuagguacauagcuuuugc

SEQ ID NO: 3727 - RNA, 22 nt, Zea mays
cggucagucacguguucgccga

SEQ ID NO: 3728 - RNA, 24 nt, Zea mays
gagccacgaacggagcgaggugac

SEQ ID NO: 3729 - RNA, 20 nt, Zea mays
gcaugccauggcagguagcg

SEQ ID NO: 3730 - RNA, 22 nt, Zea mays
cggcugcgacggcgaggagccc

SEQ ID NO: 3731 - RNA, 24 nt, Zea mays
gccgagucgagcucagccagucac

SEQ ID NO: 3732 - RNA, 24 nt, Zea mays
cccgucuccgagccgugagcgccc

SEQ ID NO: 3733 - RNA, 21 nt, Zea mays
uagcugagcauugguaaugag

SEQ ID NO: 3734 - RNA, 21 nt, Zea mays
ugcuccucgcgaggguauccc

SEQ ID NO: 3735 - RNA, 23 nt, Zea mays
acucgagagccaacgagccgcca

SEQ ID NO: 3736 - RNA, 20 nt, Zea mays
cagcgccgugggcccucgcg

SEQ ID NO: 3737 - RNA, 20 nt, Zea mays
cggcuucuucgucuucgucg

SEQ ID NO: 3738 - RNA, 20 nt, Zea mays
cgccgugcucauggaccugg

SEQ ID NO: 3739 - RNA, 22 nt, Zea mays
ggcccaacgucgaggugcuggg

SEQ ID NO: 3740 - RNA, 24 nt, Zea mays
cccgcauggucagucgcggcggag

SEQ ID NO: 3741 - RNA, 22 nt, Zea mays
gagcugccaugcgcgcccgugc

SEQ ID NO: 3742 - RNA, 20 nt, Zea mays
aaacuaaugggguguuuggu

SEQ ID NO: 3743 - RNA, 20 nt, Zea mays
accaacucggaccgcgcgca

SEQ ID NO: 3744 - RNA, 24 nt, Zea mays
agaaggaguacggcaagcuccuca

SEQ ID NO: 3745 - RNA, 24 nt, Zea mays
gcgguggcggcgucgauguggcac

SEQ ID NO: 3746 - RNA, 22 nt, Zea mays
gggucggcuggagaaagggcag

SEQ ID NO: 3747 - RNA, 21 nt, Zea mays
cccuccuauaucgucgucgaa

SEQ ID NO: 3748 - RNA, 24 nt, Zea mays
acuagucgguugcucguguguugc

SEQ ID NO: 3749 - RNA, 24 nt, Zea mays
aguuuuaguuucuauauuuaguaa

SEQ ID NO: 3750 - RNA, 20 nt, Zea mays
ugguagcaccggcaccgcac

SEQ ID NO: 3751 - RNA, 24 nt, Zea mays
caggagcucgaagacgcaguaguc

SEQ ID NO: 3752 - RNA, 20 nt, Zea mays
aaggaugaacggguggggca

SEQ ID NO: 3753 - RNA, 20 nt, Zea mays
cgaccgccuucgugccgugc

SEQ ID NO: 3754 - RNA, 24 nt, Zea mays
cgcaggucggugccggguacgcgc

SEQ ID NO: 3755 - RNA, 24 nt, Zea mays
guggacaugcaugugauaccgagg

SEQ ID NO: 3756 - RNA, 20 nt, Zea mays
accucgcugaccacauugcc

SEQ ID NO: 3757 - RNA, 20 nt, Zea mays
cggucucgacccugccugcu

SEQ ID NO: 3758 - RNA, 22 nt, Zea mays
uagucucgccagccagcgcgcc

SEQ ID NO: 3759 - RNA, 24 nt, Zea mays
acugcucccauucauggcccugcc

SEQ ID NO: 3760 - RNA, 22 nt, Zea mays
ggccggugaugugaucaaaaua

SEQ ID NO: 3761 - RNA, 21 nt, Zea mays
cgcugcccagcaacugagagg

SEQ ID NO: 3762 - RNA, 20 nt, Zea mays
ccucgccagaccuagcgcug

SEQ ID NO: 3763 - RNA, 20 nt, Zea mays
uucggcuucucccacgcgcg

SEQ ID NO: 3764 - RNA, 21 nt, Zea mays
ugccugaucgauggcggccca

SEQ ID NO: 3765 - RNA, 21 nt, Zea mays
ucagugaggcuagcucgcggu

SEQ ID NO: 3766 - RNA, 24 nt, Zea mays
cgucagcacaaugaagauguccug

SEQ ID NO: 3767 - RNA, 21 nt, Zea mays
uguggcugugggugacgucga

SEQ ID NO: 3768 - RNA, 24 nt, Zea mays
cgaggaugccaugagcaagauggg

SEQ ID NO: 3769 - RNA, 23 nt, Zea mays
cgcaggggcaccacggccgcgcg

SEQ ID NO: 3770 - RNA, 21 nt, Zea mays
gggcuucucuuucuuggcagg

SEQ ID NO: 3771 - RNA, 24 nt, Zea mays
agcaccgugagaggagugaccggc

SEQ ID NO: 3772 - RNA, 22 nt, Zea mays
agccaagccagcaacgaccguc

SEQ ID NO: 3773 - RNA, 24 nt, Zea mays
agccguccgugauccagcugcggg

SEQ ID NO: 3774 - RNA, 21 nt, Zea mays
gcugcugcgggccugcggcug

SEQ ID NO: 3775 - RNA, 21 nt, Zea mays
uagggcuuguuugguuguguc

SEQ ID NO: 3776 - RNA, 20 nt, Zea mays
cagcuugaggacggccgcac

SEQ ID NO: 3777 - RNA, 24 nt, Zea mays
acaagagugucugggccagcaucu

SEQ ID NO: 3778 - RNA, 24 nt, Zea mays
gcaccaggacccuuguucgccgcc

SEQ ID NO: 3779 - RNA, 21 nt, Zea mays
uggauucaugucaucuugggg

SEQ ID NO: 3780 - RNA, 21 nt, Zea mays
cccgagguguacccgcuguuc

SEQ ID NO: 3781 - RNA, 20 nt, Zea mays
gugauugguugauugguugg

SEQ ID NO: 3782 - RNA, 24 nt, Zea mays
gacauucuccauguauuguuucgu

SEQ ID NO: 3783 - RNA, 20 nt, Zea mays
cccaggcaaggucuccgagg

SEQ ID NO: 3784 - RNA, 23 nt, Zea mays
gcacaccucccucagguaagcca

SEQ ID NO: 3785 - RNA, 21 nt, Zea mays
ugcacucuccucccagcucga

SEQ ID NO: 3786 - RNA, 20 nt, Zea mays
cggcacgucgguggugguga

SEQ ID NO: 3787 - RNA, 20 nt, Zea mays
cucaaccaacagcugcaugc

SEQ ID NO: 3788 - RNA, 20 nt, Zea mays
aaucuagguggauuauaauc

SEQ ID NO: 3789 - RNA, 20 nt, Zea mays
caggcccggcagcccguggu

SEQ ID NO: 3790 - RNA, 22 nt, Zea mays
ucgcguucuucgcuggccucgc

SEQ ID NO: 3791 - RNA, 22 nt, Zea mays
cggcaccagcugcggcugcucc

SEQ ID NO: 3792 - RNA, 24 nt, Zea mays
cgcagcgucuuccacccggggagc

SEQ ID NO: 3793 - RNA, 22 nt, Zea mays
cuuauuugccgaguguuguggc

SEQ ID NO: 3794 - RNA, 24 nt, Zea mays
aacuggauacgaguaacuaaagaa

SEQ ID NO: 3795 - RNA, 24 nt, Zea mays
gacccuguuccgguucggcgaggc

SEQ ID NO: 3796 - RNA, 24 nt, Zea mays
auuccgacagaaacgagcaggccc

SEQ ID NO: 3797 - RNA, 22 nt, Zea mays
agaccacugggauccucucaac

SEQ ID NO: 3798 - RNA, 20 nt, Zea mays
aacuagaauggagccguucc

SEQ ID NO: 3799 - RNA, 21 nt, Zea mays
ggcuggugcgcuucaucgggg

SEQ ID NO: 3800 - RNA, 21 nt, Zea mays
cccaagcagccuuagacauac

SEQ ID NO: 3801 - RNA, 23 nt, Zea mays
uucuaagggcuaguuuggaaacu

SEQ ID NO: 3802 - RNA, 24 nt, Zea mays
gccaaaugccacuuugucgccaua

SEQ ID NO: 3803 - RNA, 21 nt, Zea mays
uuuagguccuugaacuuguua

SEQ ID NO: 3804 - RNA, 20 nt, Zea mays
cggugcugaugcgguugccu

SEQ ID NO: 3805 - RNA, 22 nt, Zea mays
gcaccagaucggucccucacgg

SEQ ID NO: 3806 - RNA, 23 nt, Zea mays
cgucgucugccuccuccucaccg

SEQ ID NO: 3807 - RNA, 24 nt, Zea mays
caccauauccaccaccauagcccg

SEQ ID NO: 3808 - RNA, 21 nt, Zea mays
cgaaauagcuguugcccuugu

SEQ ID NO: 3809 - RNA, 23 nt, Zea mays
aaugacgacaucgacgugccagc

SEQ ID NO: 3810 - RNA, 20 nt, Zea mays
ugcgaugaugauucaauaca

SEQ ID NO: 3811 - RNA, 24 nt, Zea mays
aaggacaggugcaugugggcccaa

SEQ ID NO: 3812 - RNA, 21 nt, Zea mays
uguuccugccauguaugucgc

SEQ ID NO: 3813 - RNA, 24 nt, Zea mays
gcgccgcgagcauccuuccugagc

SEQ ID NO: 3814 - RNA, 22 nt, Zea mays
acggguucuggaaguacguguc

SEQ ID NO: 3815 - RNA, 21 nt, Zea mays
ggcauggaugugaacuuggua

SEQ ID NO: 3816 - RNA, 20 nt, Zea mays
cgacgaggccaucgugccgu

SEQ ID NO: 3817 - RNA, 24 nt, Zea mays
gacgcucucgauaccuuguugcgu

SEQ ID NO: 3818 - RNA, 20 nt, Zea mays
cgaacacgugguggacaagg

SEQ ID NO: 3819 - RNA, 21 nt, Zea mays
gccgccaccagggagucgccg

SEQ ID NO: 3820 - RNA, 24 nt, Zea mays
uacgucuguugacucuuuuaggcc

SEQ ID NO: 3821 - RNA, 21 nt, Zea mays
ucgcgcgacaccaccacgagc

SEQ ID NO: 3822 - RNA, 20 nt, Zea mays
ugaauagcaaggggauuccu

SEQ ID NO: 3823 - RNA, 24 nt, Zea mays
accaucuaccguaaagcccaagga

SEQ ID NO: 3824 - RNA, 20 nt, Zea mays
gcggcgagcaggagcagagg

SEQ ID NO: 3825 - RNA, 24 nt, Zea mays
guugcuucugcccguguucuucgc

SEQ ID NO: 3826 - RNA, 20 nt, Zea mays
acacucggcacucggcaaag

SEQ ID NO: 3827 - RNA, 22 nt, Zea mays
cgugucgugcgcgauguuggcg

SEQ ID NO: 3828 - RNA, 24 nt, Zea mays
ccagccugggcaccggacacuguc

SEQ ID NO: 3829 - RNA, 22 nt, Zea mays
ccgcugcgacuacaucggcucc

SEQ ID NO: 3830 - RNA, 24 nt, Zea mays
cgccuuccucgucaugcucgccau

SEQ ID NO: 3831 - RNA, 24 nt, Zea mays
agauaagguuauguccgacggcca

SEQ ID NO: 3832 - RNA, 21 nt, Zea mays
ccaggaagcaaugcaagcaac

SEQ ID NO: 3833 - RNA, 22 nt, Zea mays
ugcgugacaucggugcaggucc

SEQ ID NO: 3834 - RNA, 21 nt, Zea mays
accaccaccaccgccuggccg

SEQ ID NO: 3835 - RNA, 24 nt, Zea mays
gccguauucggggucuucgccugc

SEQ ID NO: 3836 - RNA, 24 nt, Zea mays
uacagcaagcaacaugauggugga

SEQ ID NO: 3837 - RNA, 24 nt, Zea mays
gggagcugcugucgguauuggaaa

SEQ ID NO: 3838 - RNA, 20 nt, Zea mays
acacaggagacacaaagaua

SEQ ID NO: 3839 - RNA, 22 nt, Zea mays
cggcgugggcugcgucgucgag

SEQ ID NO: 3840 - RNA, 21 nt, Zea mays
gagcuugaugauggaguucaa

SEQ ID NO: 3841 - RNA, 21 nt, Zea mays
uggcccauggaggagcacugg

SEQ ID NO: 3842 - RNA, 22 nt, Zea mays
agguuuaauagguuugucuugc

SEQ ID NO: 3843 - RNA, 20 nt, Zea mays
aaauauggaaacuaaaauaa

SEQ ID NO: 3844 - RNA, 24 nt, Zea mays
aacgcuuaaugugacccgggcuaa

SEQ ID NO: 3845 - RNA, 21 nt, Zea mays
uccuacuuccauggaucucca

SEQ ID NO: 3846 - RNA, 23 nt, Zea mays
ccacugacugaccgcucauggcg

SEQ ID NO: 3847 - RNA, 22 nt, Zea mays
caccggcaaggggccccucgag

SEQ ID NO: 3848 - RNA, 20 nt, Zea mays
gaccaggaaccuucacgagc

SEQ ID NO: 3849 - RNA, 20 nt, Zea mays
cccuagcaaccgaacaagcc

SEQ ID NO: 3850 - RNA, 23 nt, Zea mays
ccaguaaacccauccgguccagg

SEQ ID NO: 3851 - RNA, 24 nt, Zea mays
aucggacagaguaguuguuggguc

SEQ ID NO: 3852 - RNA, 24 nt, Zea mays
agaggacuguuuagaggacgcugc

SEQ ID NO: 3853 - RNA, 21 nt, Zea mays
gaacgagccgcucuaccuugu

SEQ ID NO: 3854 - RNA, 20 nt, Zea mays
cuccuggcuagcccacccac

SEQ ID NO: 3855 - RNA, 22 nt, Zea mays
uaguucuuucuaccacacuuua

SEQ ID NO: 3856 - RNA, 22 nt, Zea mays
ggcgcaguucgucuacggcacc

SEQ ID NO: 3857 - RNA, 20 nt, Zea mays
aagcacgcguuccaggcgga

SEQ ID NO: 3858 - RNA, 24 nt, Zea mays
acaucaagaacgaccugccuaaau

SEQ ID NO: 3859 - RNA, 21 nt, Zea mays
gcgguuguguuuauaagguca

SEQ ID NO: 3860 - RNA, 20 nt, Zea mays
gcaaccaacgccgcacaucu

SEQ ID NO: 3861 - RNA, 20 nt, Zea mays
aggccaucuaccuccucacc

SEQ ID NO: 3862 - RNA, 22 nt, Zea mays
uaagucggaauggccgauagaa

SEQ ID NO: 3863 - RNA, 24 nt, Zea mays
ugucgugccaauccaacaaaaguc

SEQ ID NO: 3864 - RNA, 22 nt, Zea mays
acgcccaccacggucaccgcgc

SEQ ID NO: 3865 - RNA, 21 nt, Zea mays
auggaugaguucuaucguagu

SEQ ID NO: 3866 - RNA, 22 nt, Zea mays
cgagcccaagaagccgaccgcc

SEQ ID NO: 3867 - RNA, 20 nt, Zea mays
cgaaggcgucguggauggug

SEQ ID NO: 3868 - RNA, 21 nt, Zea mays
cggggcuuggggagcucggcg

SEQ ID NO: 3869 - RNA, 20 nt, Zea mays
auccguucucgaauauuuau

SEQ ID NO: 3870 - RNA, 21 nt, Zea mays
ucacccagugccccauccugc

SEQ ID NO: 3871 - RNA, 22 nt, Zea mays
cccgccccgcuccugcacugcc

SEQ ID NO: 3872 - RNA, 24 nt, Zea mays
auucgagcugucaacuuguguggu

SEQ ID NO: 3873 - RNA, 20 nt, Zea mays
cgaucuucggcgagagucca

SEQ ID NO: 3874 - RNA, 20 nt, Zea mays
acuaaugccgaagguggccu

SEQ ID NO: 3875 - RNA, 21 nt, Zea mays
cgaucgagagauagcgcgcgu

SEQ ID NO: 3876 - RNA, 20 nt, Zea mays
agucaugcugcggcgccguu

SEQ ID NO: 3877 - RNA, 21 nt, Zea mays
ugacacucgacaaagauuucu

SEQ ID NO: 3878 - RNA, 20 nt, Zea mays
gagcgucgucgucccugcug

SEQ ID NO: 3879 - RNA, 24 nt, Zea mays
uaaaggucauguggucaucgauau

SEQ ID NO: 3880 - RNA, 24 nt, Zea mays
gaacgucgucgauguuggggcugc

SEQ ID NO: 3881 - RNA, 20 nt, Zea mays
gacauggccaagcucgagga

SEQ ID NO: 3882 - RNA, 24 nt, Zea mays
agggcuaguuugggaaccccauuu

SEQ ID NO: 3883 - RNA, 22 nt, Zea mays
ucggcggccacgggcgguguca

SEQ ID NO: 3884 - RNA, 22 nt, Zea mays
ccccucgcucgcgcgguuaucg

SEQ ID NO: 3885 - RNA, 24 nt, Zea mays
cagcugcuccgcggggauggaccc

SEQ ID NO: 3886 - RNA, 21 nt, Zea mays
ccgccccuuggaccuggcaca

SEQ ID NO: 3887 - RNA, 22 nt, Zea mays
gaggaacuccugauaaguggcu

SEQ ID NO: 3888 - RNA, 21 nt, Zea mays
ccgcgcaccugcaacugccuc

SEQ ID NO: 3889 - RNA, 20 nt, Zea mays
augcaggcgacgguggcggc

SEQ ID NO: 3890 - RNA, 24 nt, Zea mays
auccgcugcaagggcgccgcgcca

SEQ ID NO: 3891 - RNA, 20 nt, Zea mays
cagcuuuggggucgucaugc

SEQ ID NO: 3892 - RNA, 22 nt, Zea mays
ucacgaucgacugcaccaagcc

SEQ ID NO: 3893 - RNA, 21 nt, Zea mays
ccugauggcgcucauccugga

SEQ ID NO: 3894 - RNA, 22 nt, Zea mays
gucaccgcuguccccgccgacg

SEQ ID NO: 3895 - RNA, 24 nt, Zea mays
cagcggcggcgaugucuaccgggc

SEQ ID NO: 3896 - RNA, 20 nt, Zea mays
cugacgacgacgacgacagc

SEQ ID NO: 3897 - RNA, 20 nt, Zea mays
guuuggcaaaaaagacuaaa

SEQ ID NO: 3898 - RNA, 23 nt, Zea mays
cggcuagucgacucuagucgccu

SEQ ID NO: 3899 - RNA, 22 nt, Zea mays
guucuuugccgagugcuauggu

SEQ ID NO: 3900 - RNA, 22 nt, Zea mays
cagcuagcgucacucagcuaac

SEQ ID NO: 3901 - RNA, 20 nt, Zea mays
gagcuggagcuggaggccgg

SEQ ID NO: 3902 - RNA, 24 nt, Zea mays
uccaaucucauccaauccaugugu

SEQ ID NO: 3903 - RNA, 21 nt, Zea mays
cucgaagagagauccggcgcg

SEQ ID NO: 3904 - RNA, 20 nt, Zea mays
gauccccuccgcaucgagag

SEQ ID NO: 3905 - RNA, 20 nt, Zea mays
cugccauacaaccaguucuc

SEQ ID NO: 3906 - RNA, 20 nt, Zea mays
cgaggagcugagcugcaucu

SEQ ID NO: 3907 - RNA, 21 nt, Zea mays
gcucuugagaucucacgucag

SEQ ID NO: 3908 - RNA, 21 nt, Zea mays
ggucacuuguuuucaauugcu

SEQ ID NO: 3909 - RNA, 21 nt, Zea mays
cgccuccucuucuugccgcgc

SEQ ID NO: 3910 - RNA, 23 nt, Zea mays
cuggaagggcgugguggggcugg

SEQ ID NO: 3911 - RNA, 22 nt, Zea mays
auguaaaggugacugucccaac

SEQ ID NO: 3912 - RNA, 23 nt, Zea mays
ugccauucaaccaacuugcuuug

SEQ ID NO: 3913 - RNA, 20 nt, Zea mays
ccagcaccgccucggcccgc

SEQ ID NO: 3914 - RNA, 22 nt, Zea mays
ccgaagcuccugcaauacuugg

SEQ ID NO: 3915 - RNA, 23 nt, Zea mays
ggucaaggaucucucgcaggcgg

SEQ ID NO: 3916 - RNA, 22 nt, Zea mays
gaagauggaucuuaacaaggau

SEQ ID NO: 3917 - RNA, 21 nt, Zea mays
gcguagggggccucuacgcgc

SEQ ID NO: 3918 - RNA, 24 nt, Zea mays
acgucgauggagcggaccgugcgc

SEQ ID NO: 3919 - RNA, 23 nt, Zea mays
cuggcacccucuuacaacugcaa

SEQ ID NO: 3920 - RNA, 24 nt, Zea mays
gaucgucuguagauuugggguccc

SEQ ID NO: 3921 - RNA, 24 nt, Zea mays
gacaaauauucgagaacggaugua

SEQ ID NO: 3922 - RNA, 69 nt, Zea mays
cuccgacgggaacuggaggaacugagcgguggggcccgcgcggccaaguuauccuguucgcugccguga

SEQ ID NO: 3923 - RNA, 203 nt, Zea mays
ucuuuuagggugcguuugguugcaaugacaggacgggauaggacgagacgaucccucaaauaagauuguuuuguucagggucaaggguugggacaggauuaucccaguguuguccccaguuaucccucaaaauuggagggacgagaggaugccagaggacgucccuauccugguugucccgcaaccaaacacacccuuauauc

SEQ ID NO: 3924 - RNA, 162 nt, Zea mays
cggcgguggcggcggcggcuacuguggcggcgguggcuaccgugguggugguggcugcuaccgcgguggcaaccguggcggcggcuacggcaacuccgacgggaacuggaggaacugaacgguggggcccgcgcggccaaguuauccuguucgcuaccguga

SEQ ID NO: 3925 - RNA, 64 nt, Zea mays
cgcguaggggcgcuguagggggcaccgcugcggccguggagugcccccuacagccccaugcaag

SEQ ID NO: 3926 - RNA, 70 nt, Zea mays
acuccgacgggaacuggaggaacugagcgguggggcccccgcggccaaguuauccuguucgcucccggga

SEQ ID NO: 3927 - RNA, 70 nt, Zea mays
acucccacgggaacuggaggaacugagcgguggggcccgcgcggccaaguuauccuguucgcugccgcga

SEQ ID NO: 3928 - RNA, 114 nt, Zea mays
cgcucagacuagccaaggaggcugccugcggggacccgcacgcgguggaggcggggccacgcaacguccgcagcaggaggccacaggcagcucauccuuggcuaccgaagcaga

SEQ ID NO: 3929 - RNA, 148 nt, Zea mays
acacacaauuaggccuuguucguuugugccggauugaugggucggaacgauuucugaccggauugcuucucuaauuuauauaaacuuugauuagcuggaacgauuccaggugcaauccgauggaaacgaacaaggccuuaggaagaaa

SEQ ID NO: 3930 - RNA, 70 nt, Zea mays
acuccgacgggaacuggaggaacugagcgguggggcccgcgcggccaaguuauccuguucgcuaccguga

SEQ ID NO: 3931 - RNA, 153 nt, Zea mays
gcccucuggcuagccaagaagaccugccgaugcagccgcauugcauccuccacgccgcaaaaacucaccuugugcaaccgucgccauggcugccggacggaacugccaacagagggcgugcauaggcaagucauucuuggcuaccaaaagggg

SEQ ID NO: 3932 - RNA, 75 nt, Zea mays
cggcaauuccgacgggaacuggaggaacugagcgguggggcccgcgcggccaaguuauccuguucgcugccguga

SEQ ID NO: 3933 - RNA, 70 nt, Zea mays
ucuccgacgggaacuggaggaacugagcgguggggcccgcgcggccaaguuauccuguucgcuaccguga

SEQ ID NO: 3934 - RNA, 188 nt, Zea mays
aagcuaauagugcguuugguugcgagacaggacguucuguggcguccucucucguucuccaauuuuuagggauaacuggaacaacacugaaauaguccuaucucaacccuugacccagaaccaaacaacuuaauuugagggaucgucccaucccguccugucauugcaaccaaacgcaccauaguucg

SEQ ID NO: 3935 - RNA, 87 nt, Zea mays
ccaucucugauagccaagcaugauuugcccguagucugacucugagugugcuccugcuacgggcaaaucaucuuggccaucugagua

SEQ ID NO: 3936 - RNA, 141 nt, Zea mays
cuccgaaccuguuuuguugguggucauuuaaccaugcaugcuucgaucgauggauuggugcaugcauggauuauugcauagugugaugcauguggcgcaucagugcaugguuagaugaccaucagcaaacauguucuugag

SEQ ID NO: 3937 - RNA, 78 nt, Zea mays
accauggauuuaauccggauauggauugggugaauccauaccucacacccaaucccaugaugggauuaaauccaucaa

SEQ ID NO: 3938 - RNA, 102 nt, Zea mays
auaccgaacuugucgagugaucaggugcaucuacaggguuguccaagguccgcuggacaaggacaacuguaggugggccuaaugacuugggagguuccguca

SEQ ID NO: 3939 - RNA, 154 nt, Zea mays
augagccaucgcaacacacgagcaaccgacuaguauauaaugguagggcagauugugcacagauuccugaucucacacgucccucucgcuauggauguucacuuguucuguucuauagacuuuucugaguuuucucguugacgcaaaguagaaa

SEQ ID NO: 3940 - RNA, 104 nt, Zea mays
uuugaugguuugacagaagauagugagcacacacggugguuucauaccaugagugccaugcgacgagcugugcgugcucacgcucuauccgucagucacucauc

SEQ ID NO: 3941 - RNA, 102 nt, Zea mays
auaccgaacuugacaagugaucaggugcaccuacaggguuguccgagguccgcuggacaaggacaacuguaggugggccuaaugacuugggagguucgucac

SEQ ID NO: 3942 - RNA, 73 nt, Zea mays
uaugaaaauugacccaaacccguacccuaaugggguaaaaacccaucggguuucggguuucggguacccauug

SEQ ID NO: 3943 - RNA, 102 nt, Zea mays
auaccgaacuugucaagugaucaggugcaccugcaggguuguccgagguccgauggacaaggacaacuguaggugggccuaaugacuugggagguuccguca

SEQ ID NO: 3944 - RNA, 74 nt, Zea mays
gcaauggguacccgaaacccgaaacccgauggguuuuuaccccauuaggguacggguuugggucaauuuucaua

SEQ ID NO: 3945 - RNA, 232 nt, Zea mays
ccacaaaaccggagaggauuggagagguuaaaaucccuuucuuauuuaaauugaauaaggccuaguuuggaaggcuaaaacccggagaggauugaaggguuaaaaucccuuucuuauucaauuuugaauaaggaggggauuuuagccccucuauccccuuccggguuuaagguucccaaacuagcacuaaaaaggggauuuuagccccucuaauccccuccgauuuuugaau

SEQ ID NO: 3946 - RNA, 139 nt, Zea mays
agggcuuguucgguuagcucucaauccauguggauugagugggauuggguggguuuaaaacccaaguaagucaaacuccuuccuaauuuuuuccaaucccaucuaauccauggguaauaggaauaaccgaacaagaccu

SEQ ID NO: 3947 - RNA, 279 nt, Zea mays
agggcuuguucgguuagcucucaauccauguggauugagugggauuggauggguuugaaucccaaacaagucaaacuucuuaagaaaauuuuucaaucccauccaauccauauguauuggguauaaccgaacaaggccuaagggcuuguucgguuagcucucaauccauguggauugagugggauuggauggguuuuaaucccaaauaagucaaacuucuucucaauuuuuuccaauccuauccaauccauguuuauugggaauaacugaacaagcccu

SEQ ID NO: 3948 - RNA, 139 nt, Zea mays
aggacuuguucgguuagcucucaauccauguggauugagugggauuggauggguuugaaucccaaacaagucaaacuucuucucaauuuuuuccaaucccauccaauccauauguauuaggaauaaccgaacaagcccu

SEQ ID NO: 3949 - RNA, 82 nt, Zea mays
acucccuccguuucuuuuuauuagucguuggaauaugcaauuuuguacuauccagcgacuaauaaaaagaaacagaggaagu

SEQ ID NO: 3950 - RNA, 139 nt, Zea mays
agggcuuguucgguuagcucucaauccauguggauugagugggauugaaugaguuugaaucccaaacaagucaaacuucuucucaauuuuuuucaaucucauccaauccauguguauuggaaauaaccgaacaagcccu

SEQ ID NO: 3951 - RNA, 101 nt, Zea mays
uccaguuucagggcuucucuuucuuggcagggaagcaugagaugccauagcucucugcucucuucaacccucugcccaaggagaguugcccuguaacagga

SEQ ID NO: 3952 - RNA, 135 nt, Zea mays
cuuguucgguuagcucucaauccauguggauugagugggauuggauggauuuuaaucccaaacaagucaagcuucuucucauuuuuuuccaaucccauccaauccauguuuauugggaauaaccgaacaagcccu

SEQ ID NO: 3953 - RNA, 82 nt, Zea mays
acucucuccguuucuuuuuauuagucgcuggauaguacaaaauuacacuauccagcgacuaauaaaaaaaaacggagggagu

SEQ ID NO: 3954 - RNA, 140 nt, Zea mays
agggcuuguucgguuagcucucaauccauguggauugagugggauuggaugaguuugaaucccaaacaagucaaacuucuuaagaauuuuuuccaaucccauccaauccaguguguauuaggaauaaccgaacaaggccu

SEQ ID NO: 3955 - RNA, 82 nt, Zea mays
acucccuccguuucuuuuuauuagucgcuggauagugcaauuuuguacuaucuagcgacuaauaaaaagaaacggagggagu

SEQ ID NO: 3956 - RNA, 328 nt, Zea mays
guuccggcgggggcggacugggaacacaugggaaugagaugagaucauugcucggucgugcuggccugggccgucggcgcgcguugaucuugcauguguucccuucuugcccccaucuggugccauauaagugccaaauuaucugcccucgccucgcuccuucgcuuucauuccucggccuccgcagcuagcgcaacgcaaaggcaguuccggcgggggcggacugggaacacaugggaaugagaugagaucauugcucggucgugcuggccugggccgucggcgcgcguugaucuugcauguguucucaggucgcccccggagggcc

SEQ ID NO: 3957 - RNA, 139 nt, Zea mays
agggcuuguucgguuagcucucaauccauguggauugaguggaauuggauagguuuuaaucccaaacaagucaaacuuauucucaauuuuuucuaaucucauccaauccauauguauugggaauaaccgaacaagcccu

SEQ ID NO: 3958 - RNA, 140 nt, Zea mays
agggcuuguucgguuagcucucaauccauguggauugagugggauuugguggguuuaaaucccaagcaagucaaaguuguucuaaauuuuuuuccaaucccauucaauccauguauuguaggaauaaccgaaaaaggccu

SEQ ID NO: 3959 - RNA, 94 nt, Zea mays
guuugguugaggagccaaguagaauggagucguuccaucccugauucuaggaacggagucacucuguucuguguuugguaaucuggaacggagc

SEQ ID NO: 3960 - RNA, 139 nt, Zea mays
agggcuuguucgguuagcucucaauccauguggauugagugggauuggauggguuuaaaacccaaacaagucaaaacucuucucauuuuuuuccaauccuauccaauccauguguuuugggaauaaccgaacaagcccu

SEQ ID NO: 3961 - RNA, 138 nt, Zea mays
gggguuuguucgguuagcucucaauccauguggauugagugagauuagaugaguuugaaucccaaacaaguaaaacuucuuuuuaauuuuuucuaucucauccaauccauguguauuggaaauaaccgaccaaggccu

SEQ ID NO: 3962 - RNA, 138 nt, Zea mays
agagcuuguucgguuagcucucaauccauguggauugagugggauuggaugaguuugaaucccaaacaagucaaacuccuucucaauuuuuccaauuccauccaauccauguguauugagaauaaccgaacaagcccu

SEQ ID NO: 3963 - RNA, 122 nt, Zea mays
ggcccuccgggggcgaccugagaacacaugcaagaucaacgcgcgccgacggcccaggccagcacgaccgagcaaugaucucaucucauucccauguguucccaguccgcccccgccggaac

SEQ ID NO: 3964 - RNA, 112 nt, Zea mays
gaccgccggacggccggagcacugccguaggucgcaggccccucgccccaccggcgcccgaaguccagccgccgacucgccgacucgcagguuguccagccgccggccgccg

SEQ ID NO: 3965 - RNA, 139 nt, Zea mays
agggcuuguucgguuagcucucaauccauguggauugagugagauuggaugaguuugaaucccaaacaagucaaacuucuucucaauuuuuuccaaucucauccaauccauauguauugggaauaaccgaacaagcccu

SEQ ID NO: 3966 - RNA, 139 nt, Zea mays
agggcuuguucgguuauucccaaaacacauggauugaaugagauuggaaaaaaaugagaagagguuugacuuguuuggguuucaaacccauccaaucccacucaauccacauggauugagagcuaaccgaacaagcccu

SEQ ID NO: 3967 - RNA, 79 nt, Zea mays
acucucuccguuucuuuuuauuagcguggaaguguuauuuugcacuauccagcgacuaauaaaaagaaacgggggagac

SEQ ID NO: 3968 - RNA, 129 nt, Zea mays
gcucgagaaccugcgagagcuguuccuguccaccaaccggcucaccggcccgaucccggccuggcucagcggccugagccuccuguucguucuggacguguccaacaacagccucgcgggggagauccc

SEQ ID NO: 3969 - RNA, 138 nt, Zea mays
agggcuuguucgguuagcucucaauccauguggauugagugggauuggauguguuugaaucccaaacaagucaaacgucuucucaauuuuuuccaauuucaucaauccauguguuuugggaauaaccgaacaagcccu

SEQ ID NO: 3970 - RNA, 139 nt, Zea mays
agggcuuguucgguuagcucucaauccauguggauugagugggauugaaugaguuugaaucccaaacaagucaaacuucuucucaauuuuuuucaauccuauccaauccauguguauuggaaauaaccgaacaacccuc

SEQ ID NO: 3971 - RNA, 122 nt, Zea mays
guuccggcgggggcggacugggaacacaugggaaugagaugagaucauugcucggucgugcuggccugggccgucggcgcgcguugaucuugcauguguucucaggucgcccccggagggcc

SEQ ID NO: 3972 - RNA, 71 nt, Zea mays
aacguugaaccaaagcagcguccucuaaauuuaaaggaccguuuagaggacguugcuggagagcguaaagg

SEQ ID NO: 3973 - RNA, 139 nt, Zea mays
uaaggcuuuucgguuagcucucaauccauguggauugagugggauuggaugaguuugaaucccaaacaagucaaacuuuuuaagaauuuuuuucaaucucauccaauccauguguauugggaauaaccgaacaagccuu

SEQ ID NO: 3974 - RNA, 224 nt, Zea mays
acuaggugagugcccgugcguugcaacggaaccguauaauaauacgauaacuuauguacauauguguuauauuguaaugagaaaauauuucggaauccauuugugauccuaucuauacauaaauuuuguuauuuuaaucuaauaacauacaucuauuccaugcuacagauuuuucuucuucuucuucguuuauccgaccauggugcgcuuccagacccguugcc

SEQ ID NO: 3975 - RNA, 70 nt, Zea mays
uauagaggauucagcagcguccucuaaauuuagaggaccguuuagaggacguugcuggagggaguagagg

SEQ ID NO: 3976 - RNA, 139 nt, Zea mays
agggcuuauucgguuagcucucaauccauguggauugagugggauuggauggguuugaaacccaaacaagucaaaccucuucucauuuuuuuccaaucucauccaauccauguguuuugggaauaaccgaacaagcccu

SEQ ID NO: 3977 - RNA, 71 nt, Zea mays
gaggauaccccuccagcaacguccucuaaacgguccucuaaauuuagagaacgcugcuggauccucuauau

SEQ ID NO: 3978 - RNA, 66 nt, Zea mays
gcugcagguguuccauccuuugaccauaaccuuugugguuuggucaggcuggagcucccaucugca

SEQ ID NO: 3979 - RNA, 70 nt, Zea mays
uauagaugauccaucagcguucucuaaauuuagaguaccguuuagaggacguugcuggagggaguaaagg

SEQ ID NO: 3980 - RNA, 100 nt, Zea mays
uuguuuaauuuggcacgacaaaaagcucgcaccgggugcucuaaucggcggccgauuacagcguccagugcgaguucuuugccgugccaaaauugaaagg

SEQ ID NO: 3981 - RNA, 73 nt, Zea mays
aggccgucggagauaagguuauguccgacggccacaacgggcgcucggaaauagugcuuaucuccgacggccu

SEQ ID NO: 3982 - RNA, 68 nt, Zea mays
guacuacgugaccgcaugcgucgcuguguucggcaagcuccggcgcaggcgcagccgucgcuuggacg

SEQ ID NO: 3983 - RNA, 98 nt, Zea mays
uaaaaguuauuccuuccauuucuuuuuaguugucgcuagauaguucaauuuugcacuauuuagcgacaacuaaaacgaaacggauggagucaccaugu

SEQ ID NO: 3984 - RNA, 143 nt, Zea mays
aggccuaguuuggauacuuugggauuagaguguuuuggagggauuggagaggguauaaauccccaauagaucaaauacucucucaauacauuucaauccacuccaaucccacucauuacuagaauacccaaacuaagccuaag

SEQ ID NO: 3985 - RNA, 92 nt, Zea mays
uaauuacucucuccguuucuuuuuauuagucgcuggauaguacaaaauuacacuauccagcgacuaauaaaaaaaaacggagggaguacgua

SEQ ID NO: 3986 - RNA, 149 nt, Zea mays
aaauuugcuguuuugccacucucaauuuuggcugccuguuauuauaccaucccgugucuaugacuagugggaccgucugugucuaugauuuauggguucgaugguauauuggcgaagcccacaaaugauaauggcaaaauugucaaugg

SEQ ID NO: 3987 - RNA, 245 nt, Zea mays
gcaaagaacucuuugcugagugccagucguuggcucucggcaaagacugacggccgucagcuuugggauggccgcugauggcccuuugcugagagcccccuuugccgagugcuguccugugccgaguguucagcacucgguaaaguggcucuuugccgagauccuaacuuugccgagugcggcacucggcaaagcauucuuugccgaguaaccgacaaaaggcacucggcaaagaauacaacacu

SEQ ID NO: 3988 - RNA, 69 nt, Zea mays
gacgucauaauuugugguagaggggguacgcguucgcgcggccccugcuucaucgcagaaauucuccgc

SEQ ID NO: 3989 - RNA, 140 nt, Zea mays
agggcuggaacgguuauucccaauacacauggauaggauaggauuggaaaaaagccaaaagaaguuggacuugggugggauucaaacccauacaaucucacuaaaugcacauggauugagagcauaaccgaacaagcaau

SEQ ID NO: 3990 - RNA, 81 nt, Zea mays
cgagcaguaucgccucgcucucgcccgcgcuggagcguccguccgggugagaggcgggcgagagggaggcgaggcacuggc

SEQ ID NO: 3991 - RNA, 139 nt, Zea mays
auggugcucucugcggaggugcggacgguucguggccgagggccgaacgguccgcgacuuggcguagaggcaagcgcgacgagccagacaguccgcgucugguggccggacgguccgcgcuugcgcagaggcgaugaga

SEQ ID NO: 3992 - RNA, 114 nt, Zea mays
uuggugucgccgccaaccuggagcggcgguaccgcaccgugggcauggucgacgacgguggcaggcucauggcggugugcagccgggaccagguugugcguguggaugcccgua

SEQ ID NO: 3993 - RNA, 64 nt, Zea mays
uuucuuuucuguugugaugauaauacgcggggggccggugaugugaucaaaauauuugcuacuc

SEQ ID NO: 3994 - RNA, 285 nt, Zea mays
gggggcauuaaagguggugcggaugcuuucugacggcuucugggccugggcccauaugugccacuaggcuggacuguccaucccaaguugggagugucuggcggggcucagggcaagccuuggaccucucuaggccugaagcgguaggcacggcgugaggcugguuuaacagagcagcgaucacugcccgcuuccaacggugggaggauaacaggccggcugcacugagagcccaacucgggcccagauccacauuaaagcagaccaccaucuuuuuuuuuaccu

SEQ ID NO: 3995 - RNA, 126 nt, Zea mays
ggccuuguucguuugugucggauuggugggucggaaugauuucuagccggggugcuuuucuaauuuauauaaacuuuaauuagcuggaauaauuccgggugcaauccgauguaaacgaacaagguc

SEQ ID NO: 3996 - RNA, 337 nt, Zea mays
guaggaaucauuccgacccaccaauccggcacaaacgaacaaggccuaaagaauugcuuguuggcaugguguucaacagguggaguaacuuacgccugaccgccugagagcugcuaugcagcuacaggugccuucagcucagcuccggggcgaagccaggaauuacauguagggaggccggccgaaagagccaucuuguaaaaaauuaucgcgguucaacugguuugguuacucgcacuuagcggcugucugaguuaauacuugacaaaaaaaaacaagcacagcucaacugguuagguuucucguaguggugguggucguucgggguuaauucauc

SEQ ID NO: 3997 - RNA, 256 nt, Zea mays
acgcccuccagcagcguccucuaaacaguccucuaaauuuagagaucgcugcuggauucuuuauauauagaguuucucuaaacgguccucuaucuauuugaauacuuuaaauaacugguuuagcaaaacuaaaauauauacaauacauuugagaguaugacaaauauguauguacaaaaaauaaaaauaaaaaauguuucuaauauagauauuugaguauagaggacgugauuuagaggacguuguuggagaggaa

SEQ ID NO: 3998 - RNA, 63 nt, Zea mays
guuuuaucagcaaaacaaauuacuuuguggcacugccagugaugauuugucugcaaaauggau

SEQ ID NO: 3999 - RNA, 63 nt, Zea mays; identical to SEQ ID NO: 3998

SEQ ID NO: 4000 - RNA, 288 nt, Zea mays
cuccucucacagcccggguuuugagagcgagugaaggggcucgcuuguguuagcccacgagcgccgggaaacgcccaaagguguagcguugagugggcuaggccgggaaggucgcugacaauugguaucagaggcagacagucgccauaccgcccgaaaagggggaugggaugucaggagccuagccguuagcgcccggcuuuaguaccaccucgcuagccggagggggccguggugagcuuauaagugagauuuccccuccucucacagcccggguuuugagagcga

SEQ ID NO: 4001 - RNA, 137 nt, Zea mays
ggcuuguucgauuagcucucaauucauguggauugagugggauuggaugaguuuuaaucccaaacaagucaaacuucuucucaauuuuuuacaaucucauccaauccauguguauugggaauaaccgaacaagcccu

SEQ ID NO: 4002 - RNA, 137 nt, Zea mays
gccuuauucgguuauucccaauacacauggauuagaugagauuagaaacaauuaaaaagaaguuugauauguuugggauucaaacucauccaaucucacucaauccacauggauugagagcuaaccgaacaagcccu

SEQ ID NO: 4003 - RNA, 144 nt, Zea mays
agggcuuguucgguuauucccaauacacauggauuggaugagauugaaaaaaaaauuaagaagaaguuugacuuguuugggauucaaacauauccaaucucacucaauccacauggauugagagcuaaccgaacaagcccuuau

SEQ ID NO: 4004 - RNA, 95 nt, Zea mays
guuuugucuuuucuagguacauagcuuuugcuaucccucuagauacacaauauacuuagauauguagugaaacuuaugaaucuaguaaagccaaa

SEQ ID NO: 4005 - RNA, 139 nt, Zea mays
aggacuuguucgguuagcucucaauccauguggauugagugagauuggauggguuugaaucccaaacaagucaaacuuuuuuucaauuuuuuccaauccuauccaauccauguguauugggaauaaccgaacaagcccu

SEQ ID NO: 4006 - RNA, 139 nt, Zea mays
agggcuuguucgguuagcucucaauccauguggauugagcgggauuggauggguuugaaucccaaacaagucaaacuucuucacaauuuuuuccaaucccauucaauccauguguauugggaauaaccgaacaagcccu

SEQ ID NO: 4007 - RNA, 72 nt, Zea mays
aaccgucugugcuauuuuuaguggcgguuuauuaagaaaaccgccacuagaaaucguauuuccagaggcugu

SEQ ID NO: 4008 - RNA, 108 nt, Zea mays
uauuccaauuccauguggauugaaguguauuggaauguauuggguagauuuugacuugcuaugaauuuaaaccgacucaauacuauucaauccacauggauuaacgau

SEQ ID NO: 4009 - RNA, 73 nt, Zea mays
uaaucccaguugugaugaagacauugcaugaaaagacuagagguuugcaaaugucuuucaucaagcgcagacc

SEQ ID NO: 4010 - RNA, 83 nt, Zea mays
gggaggaugaggagauggagcacgacuuugauggcgagcggcggcgagcggcaacugugcggucugcggcguccucgacugcu

SEQ ID NO: 4011 - RNA, 145 nt, Zea mays
uuaagggcuuguucgguuagcacucaauccauguggauugagugagauuggauggguuugaaucccaaacaaguuaaacuccuucucaauuuuuuccaauccuauccaauccauguguauugggaauaaccgaacaagcccuaau

SEQ ID NO: 4012 - RNA, 138 nt, Zea mays
uuagggcucguucgguuagcucucaauccauguggauugagugagauuggaugaguuugaaucccaaacaaauuaaacuuaauuuuuuccaaucccaucuaauccauguguauugggaauaaccgaacaaggcuuuac

SEQ ID NO: 4013 - RNA, 118 nt, Zea mays
gguuagcucucaauccauguggauugagugggauuggauggguuugaaucccaaacaagucaaacuucuuaagaauuuuuuccaaucccauccaauccauguguauugggaauaaccg

SEQ ID NO: 4014 - RNA, 118 nt, Zea mays
cgguuauucccaauacacauggauuggaugggauuggaaaaaauucuuaagaaguuugacuugugugggauucaaacccauccaaucccacucaauccacauggauugagagcuaacc

SEQ ID NO: 4015 - RNA, 119 nt, Zea mays
gguuagcucucaauccauguggauuaaguaggauuggauggguuugaaucucaaaccaaguuaaacuucuucuuaauuuuuuccaaucccauccaauccauguguauugggaauaaccg

SEQ ID NO: 4016 - RNA, 118 nt, Zea mays
gguuagcucucaauccauguggauugagcgggauuggauggguuugaaucccaaacagcucaaacuucuucacaauuuuuuccaaucccauccaauccauguguauugggaauaaccg

SEQ ID NO: 4017 - RNA, 118 nt, Zea mays
gguuagcucucaauccauguggauugagcgggauuggaugaguuuaaaucccaaacaagucaaacuucuucauaauuuuuuccaaucccauccaauccauguguauugggaauaaccg

SEQ ID NO: 4018 - RNA, 118 nt, Zea mays
cgguuauucccaauacacauggauuggaugggauuggaaaaaguuuuuaagaaguuugacuuguuugggauucaaacccauccaaucucacucaauccacauggauugagagcuaacc

SEQ ID NO: 4019 - RNA, 118 nt, Zea mays
gguuagcucucaauccauguggauugagcgggauuggauggguuugaaucccaaacaagucaaacuucuucacaauuuuuuccaaucccauccaauccauguguauugggaauaaccg

SEQ ID NO: 4020 - RNA, 118 nt, Zea mays
gguuagcucuuaauccauguggauugagugggauuggaugaguuugaaucccaaacaauucaaacuucuuaagaauuuuuuccaaucccauccaauccauguguauugggaauaacca

SEQ ID NO: 4021 - RNA, 118 nt, Zea mays
gguuagcucucaauccauauggauugagugagauuggaugaguuugaaucccaaacaagucaaacuucuuuauauuuuuuuccaaucccauccaauccauguguauugggaauaaccg

SEQ ID NO: 4022 - RNA, 151 nt, Zea mays
gauaaccaguuaggccuuguucguuucuaucggauugguggguuggaacgauuccuagccggauuacuucucuaauuuauauaaacuuugauuagcuggaaugauuccgguugcaauccgacguaaacgaacaaggccuuaaucaucccca

SEQ ID NO: 4023 - RNA, 118 nt, Zea mays; identical to SEQ ID NO: 4019

SEQ ID NO: 4024 - RNA, 177 nt, Zea mays
gggauuucuugggcgaaagucucggcgacggugaugcuuguggacgccgcuucuccuguugagggcgucgcauucuucaacacugucuucuuucgaugaaaguucgguccaucuuggacaagcgacgguaguguccuagacaucacucgcuuacugaaggugucguuauuaaaguuc

SEQ ID NO: 4025 - RNA, 118 nt, Zea mays; identical to SEQ ID NO: 4019

SEQ ID NO: 4026 - RNA, 81 nt, Zea mays
uuuguauaugcuacuuuacuacacuuaaugcuuguaggauuguaaugugcacuuaaguguaggaguugccugaaaccucua

SEQ ID NO: 4027 - RNA, 119 nt, Zea mays
cgguuauucccaauacacauggauuggaugggauuggaaaaaaaauaugaagaaguuugacuuguuugggauucaaacucauccaaucccacucaauccacauggauugagaguuaacc

SEQ ID NO: 4028 - RNA, 118 nt, Zea mays
cgguuauucccaauacacauggauuggaugggauuggaaaaaauuaugaagaaguuugacuuguuugggauuuaaacucauccaauccugcucaauccacauggauugagagcuaacc

SEQ ID NO: 4029 - RNA, 130 nt, Zea mays
aggccuuguucguuuacaucggauugcacccggaaucguuccagcuaaucaaaguuuauauaaauuagagaagcaagucgguuagaaaucguuccgacccaucaauccgacacaaacgaacaaggccuaa

SEQ ID NO: 4030 - RNA, 148 nt, Zea mays
aagcauccuuaggccuuguucguuugugucggauugaugggucggaacgaauccgagccggauugcuucuuuaauuuauauaaacuuugauuagccggaaugauuccgggugcaauccgauguaaacgaacaaggccuuaugcuugua

SEQ ID NO: 4031 - RNA, 148 nt, Zea mays
aaaccgaguuaggccuuguucguuugugucggauuggggggucggaacgaauccaagccggauugcuucucuaauuuauauaaacuuugauuagccggaaugauuccgggugcaauccgauguaaacgaacaaggccuaacagacaau

SEQ ID NO: 4032 - RNA, 148 nt, Zea mays
guuccggguaaggccuuguucguuugugucggauuggugggucggaacaauucccggccggauugcuucucuaauuuauauaaacuuugauuagccggaacgauuccgggugcaauccgacgcaaacgaacaagcccuaacugagauu

SEQ ID NO: 4033 - RNA, 71 nt, Zea mays
agcagaggugggcccagggacgggacagcagcgccugccugcucugccugcuggugggcccagggacguau

SEQ ID NO: 4034 - RNA, 134 nt, Zea mays
cucccugccaucuuccacagcuuucuugaacugcaucaugcaugcagcaggcugugcuguggaccugaucgaguuucaauugauccaagcaagcaagagggcaguucaauaaagcugugggaaauugcagagag

SEQ ID NO: 4035 - RNA, 148 nt, Zea mays; identical to SEQ ID NO: 4030

SEQ ID NO: 4036 - RNA, 160 nt, Zea mays
agguguguguccgugcguugcaacgggaguacgcuaggaugagcaucgacacauaucugaucagaucuuauauuuccuugggggucuggagaaaguuugcucggaagccaaacauguuaauaccugagcauguguucccuugugccucaucaacacacug

SEQ ID NO: 4037 - RNA, 124 nt, Zea mays
cuccuugccgucuuccacagcuuucuugaacugcaugccgccggcugguggaugcugcgcgcgcuugaauuccggucgaucccaagaggcgcaguucaauaaagcugugggaaacugcagagag

SEQ ID NO: 4038 - RNA, 121 nt, Zea mays
cucucuccaguuucccacagcuuuauugaacugcaugcaccugcugaugcggguggaggaguugaaacugccgcuccucugaaagaugcaguucaagaaagcuguggaagaucacaaagaa

SEQ ID NO: 4039 - RNA, 148 nt, Zea mays
guuuacaguaaggccuuguucguuugugucggauuggugggucggaaugauuucuagccggggugcuuuucuaauuuauauaaacuuuaauuagcuggaauaauuccgggugcaauccgauguaaacgaacaaggucuaauaguuuca

SEQ ID NO: 4040 - RNA, 127 nt, Zea mays
cucggcgccaagaucuguggcgccgagcuaggugccacggaggacagccacgucacgaagcucggcgccacaggcuguggcgccgagcuguguuaccucggcgccacagucuauggcgccgagcuaa

SEQ ID NO: 4041 - RNA, 275 nt, Zea mays
gcagcggucaccgcuauccgccuccccucgccgccgcccucuucucucucacgccagaugcagggcgucacugugcagucccccuccacuucuucgcgcggaagaauccgcccgcggcaccgaccggaagcuucgcggucgucuucucuccuguucgaggcgccugcguuucggcgauucgcgacgaggcgacggcgauucgggcgcgcuagcgugccgguccccgucggagcuguggacgacgaaguggagguggucagcaaggugcuccguuc

SEQ ID NO: 4042 - RNA, 164 nt, Zea mays
auaaaauagggacuuuuguuggauuggcacgacauaaaugcagcaaaaaaaaaauaggacuaagaaagaggcaaauugugucuaaauaauuaagggguacuaaggacccucuccuacuuuuuuauucauuuaguucuucaauuaacucaaaguucuuucuuuau

SEQ ID NO: 4043 - RNA, 77 nt, Zea mays
acucucuuuuucguuuuaguuaucgcuggauaguacaaaauuuaacuauucagcgacaacuaucuacauuuauaugu

SEQ ID NO: 4044 - RNA, 86 nt, Zea mays
ggaugauuauucucgcuucacuuggguguucuuuuugcaggauaaaucucaaacugagagcaccuagagggggggggugaauaggu

SEQ ID NO: 4045 - RNA, 70 nt, Zea mays
uaccaaguacaucggugcagaguggcgcguauagguauacggaguuauacguauugaugagggcagagcc

SEQ ID NO: 4046 - RNA, 161 nt, Zea mays
ggugccacggagcacccggucgaggugaucggccgcauccggaaccucgccucgggguccgcguccgcgcuggagaucaugggaagcgggacggccgugcgcgugcgcggcgacgcggucgggugccgcgacuucacccucgacggcgucuccguguccga

SEQ ID NO: 4047 - RNA, 130 nt, Zea mays
aagggucuguucgguuguaccggaacgagccaggauucauucuagcucgucaaaaucuauauaaauuagagaaguaauccggcuaggaauuaauccggggcuccaauccggaacaaccgaacagggccua

SEQ ID NO: 4048 - RNA, 262 nt, Zea mays
cgacuggcaguucggcaaaacguaccaggccaccaagaacuucuagggucggaucggggagcugagccgcgcccuucuuuauauguauauauaugcaugaagcggauuauauuggacuguuguacuguguacuaccuuguuuauuccaugauuaacauauuguuauauugacuggguuguuuguacugaaaaaaaaacacgaacgaaaccuccgucgucgcuggaucggagucaauaaggccuuguucguuucugucggauu

SEQ ID NO: 4049 - RNA, 147 nt, Zea mays
aggccggugccagugcaggcgggaagcacgggcgagaggagcguacgggagcgagagugggacgggagagcgggagcgggcgauggccgcgucgcccggcgacagcgugccuaucgccucgcucucgccugcacuggagagcgugcu

SEQ ID NO: 4050 - RNA, 107 nt, Zea mays
gcucccaauccacauggauugagugggauuggauggguuuaaaucccaacuaagucaaacucuuucuuaauuuuuuccaaucccauccaauccauggguaacgggau

SEQ ID NO: 4051 - RNA, 130 nt, Zea mays; identical to SEQ ID NO: 4029

SEQ ID NO: 4052 - RNA, 146 nt, Zea mays
gcgccgugacggcgguuauggcggcgguggcggcuacggcggucggcgcgaggcuggcggcggcggcuacggaggcggcggcggcuacagcggucggcccgaggcuggugguggcggcuaccgcggcgguggccgcggcgguugga

SEQ ID NO: 4053 - RNA, 146 nt, Zea mays
agcauccuuaggccuuguucguuugugucggauugaugggucggaacgaauccgagccggauugcuucuuuaauuuauauaaacuuugauuagccggaaugauuccgggugcaauccgauguaaacgaacaaggccuuaugcuugu

SEQ ID NO: 4054 - RNA, 76 nt, Zea mays
gguggggccgcagcaccggaugcaggcgucgggcggccuccccgugcgccgcgccgugcuguucgucgccgaggug

SEQ ID NO: 4055 - RNA, 148 nt, Zea mays
uuucucuauuaggucuuguucguuugugccggauuagugggucggaacgauuucuaaccggauuauuucucuaauuuauauaaacuuugauuagcuggaacgauuccggguagaauccgauagaaacgaacaaggccuuagaugacac

SEQ ID NO: 4056 - RNA, 146 nt, Zea mays
aaccgaguuaggccuuguucguuugugucggauuggggggucggaacgaauccaagccggauugcuucucuaauuuauauaaacuuugauuagccggaaugauuccgggugcaauccgauguaaacgaacaaggccuaacagacaa

SEQ ID NO: 4057 - RNA, 146 nt, Zea mays
gauguuauaagggcuuguucguuugugccggauuagugggucggaacgauuucuaaccggauugcuucucuaauuuauauaaacuuugauuagcuggaacgauuccggguacaauccgacacaaacgaacaaggccuuaguuauuc

SEQ ID NO: 4058 - RNA, 146 nt, Zea mays
aucuauauaaggccuuguucguuugugccggauuggugggucggaacgauuccuaaccagauuguuucucuaaauuauauaaacuuugauuagcugaaacgauuccgagugcaauccgacacaaacgaacaaggccuaaauuagag

SEQ ID NO: 4059 - RNA, 146 nt, Zea mays; identical to SEQ ID NO: 4053

SEQ ID NO: 4060 - RNA, 142 nt, Zea mays
guauuaaaccuuguucguuugugucggauugcaccuguaaucguuccagcuaaucaaaguuuauauaaauuagagaagcaaccgguuaggaaucguuucgacccgucaauccggcacaaacgaacaagaccuuagaaguccu

SEQ ID NO: 4061 - RNA, 140 nt, Zea mays
uauauaaggccuuguucguuugugccggauuggugggucggaacgauuccuaaccagauuguuucucuaaauuauauaaacuuugauuagcugaaacgauuccgagugcaauccgacacaaacgaacaaggccuaaauua

SEQ ID NO: 4062 - RNA, 135 nt, Zea mays
uaagucguuuucguuugugucggauugcacccggaaucguuccagcuaaucaaaguuuguauaaauuagagaagcaauccgguuaggaaucguucagacccaccaauccggcacaaacgaacaaggccuuacacg

SEQ ID NO: 4063 - RNA, 299 nt, Zea mays
ccagaucugaccacuaggggucuguuugguugguuucucucgccaaccuggcugugugagccaggaucacuggagccuggcucugaagauacgaccaauuugcucguaucuggugagccuggcccaaggugcuuuaaggaucgugcgagucuggauucaaaucuacaugcagacaaccaaacacagagcucgcacgcgcauagcuuggcucauagcaaccaaacagcagcuacccgcaucccgcgacgcaagcacgcgcagaugcaggcaaccaaacagaccccaggugauccaggucg

SEQ ID NO: 4064 - RNA, 140 nt, Zea mays
uccuuuaggccuuguucguuugugccggauuggugggucggaacgauuccuaaccggauugcuucucuaauuuauaugaacuuugauuagcugaaacgauuacgggugcaauccgacacaaacaaacaaggccuuagcaa

SEQ ID NO: 4065 - RNA, 140 nt, Zea mays
cccuuuaggccuuguucguuugugccggauuggugggucggaacgauuccuaaccggauugcuucucuaauuuauauaaacuuugauuagcuggaacgauuucggguacaauucgacacaaacgaacaagaccuuaguca

SEQ ID NO: 4066 - RNA, 151 nt, Zea mays
gcuacacaguaccgacgucuuguggggagccuucgcuaccucguccacacacgaccgaacuuggcauacuccgucggcuacguuagucgguuccugcaguggccgacgacggagcacgagaaggcucugaagaggaucgucugcugcguug

SEQ ID NO: 4067 - RNA, 130 nt, Zea mays
agggcuuguuugggagcaaguggaaugaaggguauugauaggacuauaaucccuugcuaucuaaaauugaauaguggaggauuauaugcccuccaauccacuccauuaccuuuacucccaaacaagcccu

SEQ ID NO: 4068 - RNA, 128 nt, Zea mays
auauuuaggguuuacgcacacccuaaguuggcucguuaauaaaaugcccaucugacaucaccaguuuuucucucugccgggcauuuuagagaggagucaacguuggggugugcauaaacacaaauauc

SEQ ID NO: 4069 - RNA, 242 nt, Zea mays
cuuuaaggccuuguucgguugugccuggaucgaaugagauuggggggauuaaaucuucuucuauucaauuuugacuaggaagagauuuaaucuccuccaauccccuucgauccagacguaaccgaacaagcccuaagggaguggauuggagggaucaaaucucuuucuagucaaaauugaauaggagauuuaaucccucugaauccccuucgauccccauacgaccgaacaagcccuaagaa

SEQ ID NO: 4070 - RNA, 140 nt, Zea mays
uucauuaggccuuguucguuugugccggauuggugggucggaacgauuccuagccggauugcuucucuaauuuauauaaacuuugauuagcuggaacaauuccgggugcaauccgauagaaacgaacaagaccuuauaug

SEQ ID NO: 4071 - RNA, 69 nt, Zea mays
aucgagccgagccgagccgaacucggucagccaccgagcugcaccgagccgagccgagcuugacucgau

SEQ ID NO: 4072 - RNA, 242 nt, Zea mays; identical to SEQ ID NO: 4069

SEQ ID NO: 4073 - RNA, 159 nt, Zea mays
cgcuuaaggccuuguucguuugugccggauuggugggucggaacgauucguaaccggauugcuucucuaauuuauauaaacuuugauuagcuggaacgauuccgggugcaauccgacacaaacgaacaaguccgacacaaacgaacaaggccuaagccu

SEQ ID NO: 4074 - RNA, 101 nt, Zea mays
gaaagaguuucggcgucaccucccuguuguucuccggacaguacacucucccugccaggacguguauccggagaacagcggggaggugcugccgaaauucu

SEQ ID NO: 4075 - RNA, 130 nt, Zea mays
agggcuuguuugggagcaaguggaaugaaggguauugauaggacuauaaucccuugcuaucuaaaauugaauaguggaggauuauaugcccuccaauucacuccauuaccuuuacucccaaacaagcccu

SEQ ID NO: 4076 - RNA, 140 nt, Zea mays
ccguuaaggucuuguucguuugugccggauuggugggucggaacgauuccuagccggauugcuucucuaauuuauauaaacuuugauuagccgaaacgauuccggguguaauccgacguaaacgaacaaggccuaaagug

SEQ ID NO: 4077 - RNA, 82 nt, Zea mays
uguuaaguuauuuagugcacaugcauagcugucugaggucuuugagacaaggacaggugcaugugggcccaauaacuuggga

SEQ ID NO: 4078 - RNA, 72 nt, Zea mays
aguuaucuagugcacaugcauagccaucugaggucuuugagacaagggcaggugcaugugggcccaauaacu

SEQ ID NO: 4079 - RNA, 233 nt, Zea mays
uuauuguuggcuccuugaccugauauacuuuagccacaacgugccagcuggaacucaucugauugaggucuccucaauugguuacuucuuuuccccaguucgaguagauaucagugcaaggaauccugguuauauucaagcagcauugacugaaacuagaagaguucuaaaugagcuuguccuggaaccucugaaagaagagcaguacuaugagguuagggagccuuucuccg

SEQ ID NO: 4080 - RNA, 102 nt, Zea mays
gagugucuggcuaugccgaguguacuacccucgguaaaggccgucgguaccgagagucauccuuugucgaggguagcacucggcaaagcagucugugucgaa

SEQ ID NO: 4081 - RNA, 102 nt, Zea mays
cucaauccauauggauugagugggauuggauaaguuuuaaucccaaauaaaucaaaaucuuuuauaauuuuuuccaaucccauccaauccauacgggauagg

SEQ ID NO: 4082 - RNA, 83 nt, Zea mays
gagccacggaacacgagauaccaagcccgcgcgagacgaucuggcucggcucgcgcagggcggcaccucgcguuccacgcaaa

SEQ ID NO: 4083 - RNA, 229 nt, Zea mays
uguguuuggucgucauagagaacagcuuagugucaccaagacuuucggaaacgaaugacugaaucuggcuuguacagcuuaaugaugaugucacaagcaaauaaaacacguggaucuauacuuagaaucagauguaacaugcagugaacugacauucagaaugaguaggagguauuucucaucaauuagaucagacuaaucuagguuuuccucauuaugccaguacugc

SEQ ID NO: 4084 - RNA, 287 nt, Zea mays
auacucugaugcugacugggcuggauguccugacacccgacgaucuacaucugguuauuguguuuuucugggugccaaucuuguugcuuggucgucuaagcggcaacauacaguaucccgguccagugccgaggcagaauaucgagguguggccaaugcuguggcugaaauuuguuggcuucgccaauuguugacugagcuuugucauccuccucgucgugcugcuguggucuucugugauaaugucagcacaauguaucuggcauccaacccaguccaacaucaac

SEQ ID NO: 4085 - RNA, 287 nt, Zea mays
cggggaccgcggcgcggcggggugcggggagcggcgcgcgcggcggcggcccgugggggugggcggcggggagucguugugggccggguugaggagcaggugcaggaagcaggcgacgucgagcaggugccgccccagcucggagagggauaguauccagugcacaagggccacgccgugcacaaaugcacaaaacgaaaccuggucguccgucucucauccaacggccgucguaaauaugcagaugaacccucccgcagccuccguagcuugccgagucuguuuug

SEQ ID NO: 4086 - RNA, 144 nt, Zea mays
gcauccuuaggccuuguucguuugugucggauugaugggucggaacgaauccgagccggauugcuucuuuaauuuauauaaacuuugauuagccggaaugauuccgggugcaauccgauguaaacgaacaaggccuuaugcuug

SEQ ID NO: 4087 - RNA, 65 nt, Zea mays
cuggucucaacuccgccuauguugucucagcauauguuagugcagcauagucuggcccuaagucu

SEQ ID NO: 4088 - RNA, 99 nt, Zea mays
ucguucgaaugcgcucaucgggcucugcaaagguuuugggccuguacaacucguagcccauucaacagcagcccagcagaggcgccgcuuugaccgcaa

SEQ ID NO: 4089 - RNA, 144 nt, Zea mays
auuccuuaaggccuuguucguuuacaucggauugcacccggaaucguuccagcuaaucaaaauuuauauaaauuagagaagcaauccggcuaggaaucguuccgacccacuaauccgauacaaacgaacaaggccuaacuugga

SEQ ID NO: 4090 - RNA, 93 nt, Zea mays
accuugacgccgccugccaguggaugggacgggacgcauuaaaugcugagagggcacgucgcccgucagugcaguggcaggcggcgcauccuu

SEQ ID NO: 4091 - RNA, 85 nt, Zea mays
cgcccccgccgcggcugcagcggcggcguccccgcggucgcccaugccgcaggagacgccggcgaugcagaagcggaggcagcgg

SEQ ID NO: 4092 - RNA, 68 nt, Zea mays
gguuggaaucuaaagugugguagaaagaacuacauauaguuuuuucuaccacacuuuagauucucacu

SEQ ID NO: 4093 - RNA, 64 nt, Zea mays
ugaauaaacaaagaaauacccaauauccugugggaacaagauauuggguauuuucagcuuuccu

SEQ ID NO: 4094 - RNA, 264 nt, Zea mays
ugcagcgugggaugugacgugagguccccgguggcggcuucaauguuccaggagcuaaggggguguuugggagugaaguuuuuucacaguuuuggaagaauacugcaguauucuaaaauacugcaguauuauauauauaaugguguuugacaagcuagcuaaaaucucuguuuucaaaacugaaguauugcaaauacuauaguuguuuuaaggcauucuaaacuuagcucuggaccucaguuuucaaaacugcgguauuguaaa

SEQ ID NO: 4095 - RNA, 94 nt, Zea mays
cugagaaggagcucguugaagguugucuacauugcaaucagugcucaggaggagaugcaggcaacauggaggacuuugaggaguuucaggacua

SEQ ID NO: 4096 - RNA, 67 nt, Zea mays
augaaaucauaaagugcgguauaaagaacuacauauaguucuuucuaccacacuuuagauucuuucu

SEQ ID NO: 4097 - RNA, 526 nt, Zea mays
ggguuuugccgucccaaacccguacccgugaaaaauaucuaugcccauuaaaaaacccauacccaugacggguuugagauuuugcccaaacccguacccaucggguuagcggguacccauggguuacccgcggguuucaucuccaauauaauuaucuucucauaaucaauaaguaucauaaugauuaaugauaucaugauccaaaaucuauguaaugaacaacgaguucaugauuugguauaaaaauuauuaguagagagaaugaaauacaaauaauaaguuguauaauuaagugaccuugcacuaaguuauccauccaccacauauauaacacuaguaaaaacuauaauagcaagcaagcaacacucucaccgauuacugauacauucaccaauuguuaaaaauuaugaagcaaauaaggaauaacaaguuuguuguucguuuauaaaauaaaaugacaauaugcacuagguuuggucggguuuaaaaaacccacggguucacggguuuggguacuauaggaaca

SEQ ID NO: 4098 - RNA, 68 nt, Zea mays
uuugacacugugucuauccuccgaccauaaccuuugugguuuggucugggauggagcacccaucugug

SEQ ID NO: 4099 - RNA, 123 nt, Zea mays
aaucacucgcuuagccaagaaggccugccaucauccacacaguacacccaucaucaggguggucucccaagacgaaccaaacaguggagauaggcaagccauucuuggcuaagggagauaggc

SEQ ID NO: 4100 - RNA, 164 nt, Zea mays
uguggauuugaugauaaauucaauugcccgaugauaauacgcugcauuuuuuucgcaaugcucaguggaaagagaagucguuuucagguuugacggcucacggugaccacaagggguaaccacugccaaaaccauguauugaaucaucaucgcauugcagcagc

SEQ ID NO: 4101 - RNA, 268 nt, Zea mays
  misc_feature (244)..(244): n is a, c, g, or u
aaccaaccaucgugcaguagucacuguggguguugauuauugauucaaguucucccaauuccuuuucuaacuagccaagcacccccucgguguccucgcugguaugugaaguugcucucgaaguugcaccaacugaagagaagauuuucuucaaagcaucgcagcaccaggaaacaauugcaaaggaauuacccugaagaugcucuaaaguuuccaauuguggcagaaccuuccaaguuauugngcccacaugcaccugucuuugucu

SEQ ID NO: 4102 - RNA, 63 nt, Zea mays
acagcacccuacuccaccacguggacggcuccggggucgccacguggcuggggaggacgauau

SEQ ID NO: 4103 - RNA, 76 nt, Zea mays
gaagguggcgucagagguguuuggagugaccaaagggagcauuggugaaucuaaggauacuugguggagcgugguc

SEQ ID NO: 4104 - RNA, 70 nt, Zea mays
aggauaccccuccagcaacguccucuaaacgguccucuaaauuuagagaacgcugcuggauccucuauau

SEQ ID NO: 4105 - RNA, 111 nt, Zea mays
ucgggaggguucggaguccggaucggggaucugcgacaacuacguuauucaacacgucaucagcacugcucuaccccgacucguggauccgaucggcaccgacucuccauc

SEQ ID NO: 4106 - RNA, 265 nt, Zea mays
cucuacucccuccagcaacguccucuaaacgguccucuaaauuuagagaacgcugcuggauccucuauauguagaguuucucuaaacgguucucuaucuauuugaauacuuuaaacaaccgguuuaauaaaacuaaaauauguacaauacauuugagaguaugacaaauacguauguacaaaaauuaaaaaauuaaaaauauguuuaauauagguauuuacauauagaggacgugauuuagaggacguuguuggagagaaaguag

SEQ ID NO: 4107 - RNA, 243 nt, Zea mays
aggcuauggcgccgaggucguguugcguuggcacaacccagacgcguggcgucgacguggcaccgaacucggcgccauagaucuuggcgccgagcucgguuccacgucgacgccgcgucaccucguggacaacagcgcggcagguagcucggcgccaagaucuauggcgccgagcucggguaccacgucggcgccacgacguccguuugugccaacgcagcacguaccucggcgccauagccu

SEQ ID NO: 4108 - RNA, 67 nt, Zea mays
augcgcgcucacgccacugguugguucgcugcgcggugggaccugugggucagcgcguucuucaccu

SEQ ID NO: 4109 - RNA, 254 nt, Zea mays
uauucuuucuggaucuaaucugucuguucucgggugauuuuugaugauaaaaaagaguucaaucauauugaacugauaccuuuaugugaucucauaaaaucgaugcggauuaggaguucuaggguucuuagaauggcuuugauaccauuguuagaaucuauacugucaaggaucgauucguaaguccuuagaaaaccaaucuguaacuggaaguaaaaucuugaugacguguagaucugaucuacuaagaggaa

SEQ ID NO: 4110 - RNA, 253 nt, Zea mays
gauugaagauguccgcgacgcccugcgucucuugcauaguugucgaugugcugcaauauggcucgcuccuccgcgccagccagcgcuaggucuauggcguugugcgcagucgucgucgcacuggggcaauccggcaguggucgugcuggccgcagcacuggagguggccgugaugcuccugaacugaggaugcggcccguagggaaagccacaaauggugaugcagggauguacgaagacaaagugcagcaca

SEQ ID NO: 4111 - RNA, 163 nt, Zea mays
uugccucacuccuauggauguugcucuccaggacaggugaguucaucuuuaacucacagcuugcugcucauuguuggaccgguagccaucaugucucgcauggcuaggcccucauacuccucaucugacuuggucgaguguucguccauagagccgacaucua

SEQ ID NO: 4112 - RNA, 96 nt, Zea mays
ugcccuguaucgucugcaagugaugcguggagaggcaaugucccaucuaauggcauuguuggaggcaaccaagaucacuuuggaugacagagagga

SEQ ID NO: 4113 - RNA, 100 nt, Zea mays
cccggcucgccguggcgcgcgccgccgccucgggggcgcgcggcggcggcgacgccgagacgguguucuucgacggcggcgcgcacuacggcgaccuggc

SEQ ID NO: 4114 - RNA, 73 nt, Zea mays
gucaucaguuuuacuugaugugaagccaugggacgaugagacugacauggccaagcucgaggaagcuguuagg

SEQ ID NO: 4115 - RNA, 146 nt, Zea mays
uaguacauauggugcacauauuaaaucaucacuauuuauuuuagauuuaacgucucuaguugaucauugcaauuuauaaauaauauuuuccaccacuauacucuaaaaugagugaugcugauuuaauauaugcaccauguacacua

SEQ ID NO: 4116 - RNA, 70 nt, Zea mays
cgaauaauaagugaaucuaccuggagcguagcagagaggagagccgcagugguguucacugguuguaaug

SEQ ID NO: 4117 - RNA, 68 nt, Zea mays
aggcgugcugccaucaccgcggccuccccgaggacacgcgccgggcugcggcuggugguguuaauagc

SEQ ID NO: 4118 - RNA, 65 nt, Zea mays
acgcguucgcgcuguucguggcggugucggugggcgcgaacaucuccggcgggcacgugaacccg

SEQ ID NO: 4119 - RNA, 248 nt, Zea mays
gcuguccgccgccguauucggggucuucgccugccucuaugggcucagggcggacaggggcccuaaagaucuccucgggccaaggaaucguuccccuccggcgacucccucccuccuuucgucucaggccuucacuguaucuccaucaaagcgaaggauuagaggcuacuccguuaggaggagaggaaaggaauugcgagccuuguguuggagaagucgaagacugagaguauaugguggcuccauug

SEQ ID NO: 4120 - RNA, 241 nt, Zea mays
acucgcugauggagcaggaguuggaccgccaggugcgaggcaucgagcucauagcgucggaaaacuucgucugccgcgcggugcucgaugcacucggcagccaccucacuaacaaguacuccgagggggccccgggugcucgcuacuacggcgggaaucagcacaucgaugccaucgagcggcucugccaugagcgcgcccucacugccuucggucucgacccugccugcuggggcgucaa

SEQ ID NO: 4121 - RNA, 158 nt, Zea mays
  misc_feature (35)..(35): n is a, c, g, or u
uggcaugaagcgaccuaccaagaaugagaggcugngcaacccccggcacaaguaggaggaagaacccgagcaaccgagccacagggaggagggucggaacgaacaacugcgccuggggcaguuaaggcauccaagcuuggugaaguugaucggauauu

SEQ ID NO: 4122 - RNA, 65 nt, Zea mays
cgaguaacuccucagcucgggguuccgccugaagaagcaggagcugcaguagcugcggaaucuuc

SEQ ID NO: 4123 - RNA, 425 nt, Zea mays
uuccccuguccugcugcugcugcuacugcugguuagugguuccccaaacccaagccuucgauucgcccgcccgcccgcccucuagucucaccccucuuguccuuccugguuccuauaaguguagccaccaguccccuagguugcugcugcuaccgccgguuagggcuuccucaaccccuagccuuugacucgcgugcccgcgcucucgcgccagccggccccgcgcccgugguugguuuccgcgccgcuagccgugacggaaggcucguccaggguccccguucucgaccuccggcucggcgguucuguaccgcgcgucgcgucgguccggcgccguguggugcggugccugccggacaccugcccagcgaaggcguggacggguggucauccagguugcgggagcacugccgagguuuaggggg

SEQ ID NO: 4124 - RNA, 101 nt, Zea mays
cgaugagacugacauggccaagcucgaggaagcuguuaggagugucaagauggaagggcugcucuggggcgcuuccaagcuugucccagucggauauggua

SEQ ID NO: 4125 - RNA, 73 nt, Zea mays
agcgcaccggcgagaaccaguucguggugauggacgcgaggucgccgcagcuggacaucgucgccgaggugca

SEQ ID NO: 4126 - RNA, 138 nt, Zea mays
agaagccaaggcggccuuaugagaaggagcgccuugaugcugaguugaaauuagugggugaauacugcacacgccacagcucacgcuugcaccucaggcuccuucucauaaggccgccuuggcuucuugaaagucuua

SEQ ID NO: 4127 - RNA, 65 nt, Zea mays
gccacgccgcaguacgcggucuggcuggcgcgguacggccggccguucguguacugguucgggcc

SEQ ID NO: 4128 - RNA, 169 nt, Zea mays
ggucgagaacagguaccauaggaugagacgcuuggaggaugcugugauguguuugugagagaucuaggucaucgucucccagucaacuuuggguugcuagaccggugucuccuuauaauguaauuauucauuuuguacagaacucuuauuauauaguacagaugugaca

SEQ ID NO: 4129 - RNA, 58 nt, Zea mays
uacgccacaacgcagccgcggccgaggccacgccucgccgcgcgcugccucgccgccg

SEQ ID NO: 4130 - RNA, 73 nt, Zea mays
ucccgugccagcgcgugcugguguguguggccgagaacgacuuccugcucaaggagcgcgcgcugugguacca

SEQ ID NO: 4131 - RNA, 73 nt, Zea mays; identical to SEQ ID NO: 4114

SEQ ID NO: 4132 - RNA, 251 nt, Zea mays
ggggauugucaugacagcaucaacauaccucucauuccucuccuugggcuugaccaggugugugggagcaucauagucagggauguucagccacaggccgugggagacggcggugugagcacccucccugaggcugaagggguauccacgcacaaagucagcacccucacgguaggggucguacaggguguugaagaagaacgguguggacgggcugaggagguucuugaugugcugcucaagagcauuga

SEQ ID NO: 4133 - RNA, 94 nt, Zea mays
cacaaaaaagaggauagaccucaugcgcaggucaauaacacaacuaaaacguuaccugguggaccugcagguggggucuauccuccuuuuugug

SEQ ID NO: 4134 - RNA, 64 nt, Zea mays
ggccccgcggcgccgucgccgaggucgucgagcacgaugccggcggcggggcagucgccggugc

SEQ ID NO: 4135 - RNA, 96 nt, Zea mays
ucuuucuccggugguguguggggcguuccccgccacagacuccuacuauaccugcggugacucauaagcgcaucccaguuacuaucauuccucucu

SEQ ID NO: 4136 - RNA, 79 nt, Zea mays
ccgucgccgucgccgucgggcuuggucuggaacuugguguucuccuugaucccggucagccggcuggcgaauugcgcgc

SEQ ID NO: 4137 - RNA, 173 nt, Zea mays
ggggggggggggggaggggggggggggcgaauggguaccucgaagccggccgggaucacacucuucucuucucccuggccggaccggagucaggcagccgaagcaagaaaagcaagcggcuuuggaaguugggauccauggcguccaccucgugcuuccuccaccaguccacc

SEQ ID NO: 4138 - RNA, 206 nt, Zea mays
cuccaacuacgacggccgccucucgcucgacaagcucuacgccgcgcgcgccgccgcugcguccggugguggcggaggaggagggggaggaggaauuguagcagagcgcucgaugccgacgucgccgcccgcggcggcggcggugccggccacggggccgaggccaccggucacgucgauggagcggaccgugcgcgcgcuggacc

SEQ ID NO: 4139 - RNA, 74 nt, Zea mays
ggacugguggccacuggcaucgucggcggcgccuugucgcaugcggugcacgccgagaccgucaagaccaucaa

SEQ ID NO: 4140 - RNA, 182 nt, Zea mays
ggagcucagcaugaggcagccauugugcauucuuggagauugacaugucaacaguacugcucguaggcucguagcauugggcgacgcguguacuguggauaacuauuggucguaggcucguagcgucggcaaaguugacaugccgugucuggugagcgaggcguguaccaugaauaacuguu

SEQ ID NO: 4141 - RNA, 226 nt, Zea mays
gggaauggagacgcucucggcgaagcaggagggcacaguggacgugaagcugaagccgacuucuaaccaauccaacucguaggcgggcgggaagcggaugugccaacuagaagaguggucucucucggcgcuugcuugacaaacguguguuauuaaccguuguauauaauguuauuaauuaauguccuuuauucccugaugcuucuguuguggcucacguucucaa

SEQ ID NO: 4142 - RNA, 107 nt, Zea mays
agguggcaggcggcggcgcuugcggcgcuggccggcugggugugggcggccuccuucuacgaccucacgcgccgggcgcgcgcgcucguccagccgugggucacgcg

SEQ ID NO: 4143 - RNA, 88 nt, Zea mays
auacgaucaagugacuggugaugugauuugccauggugagaaaacuucuuacaagaugggcgcaagagcuuuccuaguggccauucgc

SEQ ID NO: 4144 - RNA, 68 nt, Zea mays
gcauugcuucacggugacggaugaugaugucgaaauggaacauuaacauuuucagcguuagauuguug

SEQ ID NO: 4145 - RNA, 78 nt, Zea mays
ggaagaaguacgguagaucguacgaugugacgcugauaaagaaagaguucauggggaggaaucugcuggccaugaaug

SEQ ID NO: 4146 - RNA, 85 nt, Zea mays
aucagccagaggcgucccgugcuuuuggccagaggcggcggcaucacuugcuuuuggccagagggauacggcuccuugguccgag

SEQ ID NO: 4147 - RNA, 125 nt, Zea mays
acgucgcgcgggucaacaugugccacggcgaccgcgaguggcaccgcgaagucauccgcgcuguccggaggcucaacgacgagaaaggguucgcggucgccgugaugauggacaccgagggcagc

SEQ ID NO: 4148 - RNA, 95 nt, Zea mays
guuauccuuuuggcggcucguuggcucucgaguucugcuauccuccaacgggaggaucuucaagauuugguuguagcggggucgcaacucuuugu

SEQ ID NO: 4149 - RNA, 260 nt, Zea mays
ccggucggggcgcggcggagugggcggcgguggugcuguucauggugcuggcggucguggugcugcugggcgccguggccguccuuguggucgugcugcugcugcagccccgcgcgccguacguggcggugcgugcggcgagccuguacgcacugguguacgggcagacgagggcacuggaugacgugcaggucacgguccggguggaggcccgcaacggcaacgcgcacucagcggccuacuucucgcgccucgagugc

SEQ ID NO: 4150 - RNA, 65 nt, Zea mays
acucguucgcgcuguucguggcggugucgguuggcgcguacaucuccggcgggcacgugaauccg

SEQ ID NO: 4151 - RNA, 171 nt, Zea mays
cgccccaaauccaggccgucacggcucacuggcuugccaccgccgccccggcuaucuacgggaugccaaggauugaggggaagcggggucagguguggggagaggaggaaaggauggagacucaccugaaccuggagccguguguccgugacggugguggagaccaagcag

SEQ ID NO: 4152 - RNA, 132 nt, Zea mays
agggccuuguuugggaguaaggguaauagaggggauuggagggguuagaaucccccacuauucaauuuuaaauaguagaggauuauagcccccucaauccccuucauuucacuugcucccaaacaagcccua

SEQ ID NO: 4153 - RNA, 582 nt, Zea mays
ucauuuaacguuaucgguuacccauuacguuaccaacaucugaaccaacaucuuccuauggguuugaauacagcgccuaugcagagguggaagauauauauuauuguuuuuaagacguacagcggauggacaauacagcucccaauuagcuuuugggaaccuaacgacgauacaaaacaaacucuauuuggagggugcaugcacaaaauaaaugcaaacucuucaccuagacccucauccagaacaagauccucacagcagauaaucuugagcuugaaggcuggccucaccuugcguaggcgguauuugagagcaucgaaaggauugauugcuccaauugaaauagcauguaaaacaaacuacaaaaugaucuuaaacuucaaaaccuaggcucuauuuaagugauaguaacucugaaagauaacgauaaauguagguuucuccaucacuuggucacuacccuacaauacuccauggcucuccaaacuggcaugauccuaacuacucgaucgccacagcaaucuaggguaccguuugauucauauauuuauaacguaauggguaagugauaauguuaaauca

SEQ ID NO: 4154 - RNA, 102 nt, Zea mays
cgccucuuagagccgaacgcugggugucagauugaauaaaaacugccuugagaaguguuguauuucguuucauacuuguugugucaacgguuucauuuuuua

SEQ ID NO: 4155 - RNA, 74 nt, Zea mays
uuguggccgucgacggcuguugcagaugguaggugaccauuccaucuaccauucaaagcugucgaaucaacacu

SEQ ID NO: 4156 - RNA, 118 nt, Zea mays
gaucugcgcagccccaacaucgacgacguucaccccggcgaggaaccccguguuuugcguggaggagaaggcaagucguucaacgcucgucgacguucgaaguuaugcgcaaaucgga

SEQ ID NO: 4157 - RNA, 262 nt, Zea mays
ugggaggcauuggauucaugucaucuuggggaugaaguuagaaagaacgagcuuaagcuugacucuacagugacagaaaagggcaaaaacuggagcacaggucagcgucaacuugugugucugggaagggugauucugaaacggaggaagaucuugguuuuggaugaggcaacuucauccguggauccaauuacagacagcuugauucaaaaaaccuuaaaacaacaauuucucaaaugcacaaugauuacaauagcucacc

SEQ ID NO: 4158 - RNA, 100 nt, Zea mays
ucaggaauggcagcaugcaauggacgaggagauuguugcucuugaguguaucgauaugugggaacuuguuccuuguccaccacguguucgcccuaucaca

SEQ ID NO: 4159 - RNA, 232 nt, Zea mays
cuuauaaaauuggugcacguggugcauauauuaaauuauacaccacugauuugagaucuaacgucuguaggggaucauuuaauuuacaaauaacaccugccagggucucaccacuacacaccaccacuuuggagggugcuuuuaguaaaauaugccaaacaccucgaaacguucgaucuacaaugagaggggaugauuuaauaugugcaucaugugcaccaaggcuuccaug

SEQ ID NO: 4160 - RNA, 262 nt, Zea mays; identical to SEQ ID NO: 4157

SEQ ID NO: 4161 - RNA, 121 nt, Zea mays
gaaauuggagguacggcugaggaggaugcugcaacguucauccaggaaagcaaaacacaaaagccuguuguugcauucauugcuggacuuacagcacccccgggccgucgcaugggucaug

SEQ ID NO: 4162 - RNA, 146 nt, Zea mays
gcuuguugagggcuuguucgguugcuagggguuuggaggggacugaagggauuaaacccccuucuauucaauuuugaauaggaggggauuuaauccccuucaaucccccucaaaccacuaguaacugaauauggccugagggggcg

SEQ ID NO: 4163 - RNA, 170 nt, Zea mays
gugcaaucaggcgaucuggugcauccaaucaaaaauccaacaauaaccgccauuuuauacuuaaccucuucuaucuaaaaccuauuauccauuuuacauuugacgcuuccacuaaaauaggugggcauuguuuggauuuugauuugaugcacuaggucguuugguugcac

SEQ ID NO: 4164 - RNA, 186 nt, Zea mays
uacauuauacugcaaugaaauguugauacccuccaugauaguaaaaguugccuuuguauuuggaagcauccaacuuaauacuauuuaauaguauccaagcaugcacugcgccagagucagaacagaacacauagccaccuucuuguuacaaugguagggaucaucaguuguaugcaggaccauccg

SEQ ID NO: 4165 - RNA, 218 nt, Zea mays
cuuucuuccaugcagaggcaaccuaagauggacagcuuacaagaucucucgauuuuggaauuauacauucuugugugcaugcacagauuagaaaguaaggagcaaaccucauacaacuucaccaggauaaugaaagaauacagauccauacaagacgccuauaagacuucugauaaauaugcaagcacuguuuguuuuagggccuuugagcaccuuuu

SEQ ID NO: 4166 - RNA, 167 nt, Zea mays
ggagacacucggcaaagaaugcuuugcugagugucaaacacucggcgaacagcgacgcucggcaaaggaccgucagcagccgucuauaacugacgacguuauauuugccgagcaucgggcuuuggcacucggcagcgaagcuacuuugccgagugucucaaggccga

SEQ ID NO: 4167 - RNA, 202 nt, Zea mays
uaguguacauggugcauauauuaaaucagcauuacucauuuuagauauaaugucucuaguuguugguauauuuugcuaagaacacccuccgacguggugaaguauagcgguggaaaauauuauuuauaaauugcaaugaucaacuagagacguuaaaucuaaaauaaauagugaugauuuaauaugugcaccauauauacua

SEQ ID NO: 4168 - RNA, 353 nt, Zea mays
ccacaguggaugcugucuuugcuaagaucgacgagcugcuggguucuauccuggagaagaaaaaugaaaugguguccagcacaugagcaagguaaaaaugauugggugcagugcagauccgacaaguucauguaaugcaagucaccucucaugauaggaacuucuccaggggaauauaucugaagcacaggacgacacguacaaguaauguaagccagucucacguaauggaaauuucuccauguggauguggucaaagcauaggauuuuuuuucuccaauuguuaacuguacgcgaauggaagcgacagaucauuuguagguugugagggcuucaaagaucaucugcugcug

SEQ ID NO: 4169 - RNA, 128 nt, Zea mays
acggcgacuacuggaagggcgugguggggcuggccaagggccuccgcaagguccgcucggccuacccccugggugguggccgugcugcccgacgugcccgagucccaccgccgcauccucgucucgca

SEQ ID NO: 4170 - RNA, 75 nt, Zea mays
cguguuaaggaguucaagacagagagugaagcuacuaacuuuggcuuagcugauguugugauauuccauggcguc

SEQ ID NO: 4171 - RNA, 90 nt, Zea mays
uccucaaaucgaucgucuguagauuuggggucccaagccguaucauuacggacaaugggacccaguuuacaagucggaucuuccaggagu

SEQ ID NO: 4172 - RNA, 128 nt, Zea mays
agggucuguucgguuguaccggaaugagccaugauucauuccagcucaucaaaauauauauaaauuagagaaguaauccggcuagaaauuaauccggggcuccaauccggaacaacugaacagggccu

SEQ ID NO: 4173 - RNA, 273 nt, Zea mays
ccgucgggccaauucagcuugaccucgagaauguuuuucuucaagacuagaaagcugccgagccauaucggcauuugccgccucuaagucagaaacacgccguugaagcagcaccggauuccaacgcgcuagagacaaagcuccuucuaggacagaagcacccugcaacuucagccgacuagacaucucaucgaccaaugccuggagguuggagaagaaugagggaacccccaagucgugagaggucaauugauggcucggcgaagggucacc

SEQ ID NO: 4174 - RNA, 224 nt, Zea mays
acugcuagccuggcugcucaauucggaugucgucaugucagacauauggaaaccguauggguggaccaauaggucggguuuauggggacagaccccaccggguugucguacacggcuaggucccgacccuggguucccaucugcguuugacgugggagcccucgucuucggcuguggcuauuucugcaugauccuaucggaagucugggcacguggggagucca

SEQ ID NO: 4175 - RNA, 90 nt, Zea mays
uugcaagcccaaagcccucgguggcuuggggguucucaaccuugacaaguucggacgcgcccuucgccuucgcuggcuuuggaaggaaug

SEQ ID NO: 4176 - RNA, 115 nt, Zea mays
uugucuuacugagucaccaggucgcggguucuaagcagggaggcuugccucgguuuaucccuucccuagaccucacucaugugggagccuccgacacugggacucccggcagugu

SEQ ID NO: 4177 - RNA, 255 nt, Zea mays
ugcuguucuacaacacaucagcgcucccaagccagcaaugcuuccugcugccuuuucucguuucaugucaguuucaucugcucgccuagaggaucguggauuugaaacugccacuguagcagaugucuugaagucuaaagggaagagugcugauggaucuuggcucuggugcaccacagaggauagcgucuaugacgcugucaaaucuaugacucagcacaacgugggagcuuuggugguugucaaaccuggaca

SEQ ID NO: 4178 - RNA, 255 nt, Zea mays; identical to SEQ ID NO: 4177

SEQ ID NO: 4179 - RNA, 76 nt, Zea mays
cuucuguuggagccaguggggguauuuugguggcauggaaaagcuauuuagguuccaccggggcuuccaaaauuga

SEQ ID NO: 4180 - RNA, 422 nt, Zea mays
  misc_feature (334)..(334): n is a, c, g, or u
gcgcucucuucggcgaggcccgcgugacgaugccagaggggcaagcaaagccggcggcagcuccggcagcccggguacggcccgccgugcucuaccugggcccgugccggcgcgcccccgacuaccugacgcgaguucccgggcgacuacgugggacaccggggcugcggcggacccgaacuucgccaagaaccgggagcuggaggucauccacucccgugggccaugcugggcgcgugggcugcguguucccggagcugucccccaacggcguaagucggcaggccggugguaaggccggucgcaacuucacgaggguggcuggacuaccucngaacccaccgaccaccgcaacaucuccauuggccugcagucggcucauggcccaucgaggguaccggucgcgcggccgucgagagucg

SEQ ID NO: 4181 - RNA, 218 nt, Zea mays
ccucaaguccaucgucuguagauuuggggucccaaaccguaucauuacggacaacggaacccaguuuacaagucagaucuuccaggaauauugcgagggcauugucacccaacucugcuucgcauccguggcccacgccagaagcaauggccaaguggaaagggcaacugcagagauccuuaggggacuccagacgcgcaccuacgauuacuugaaga

SEQ ID NO: 4182 - RNA, 89 nt, Zea mays
ugcggaggcgagaugugcggcguugguugcugagaaggaggcgcgugcggcuguugaauaugccaccauugccgcagauaagguuaacc

SEQ ID NO: 4183 - RNA, 128 nt, Zea mays
guccuaguccauagggauggcaaugggucgggguuggguucagguggagcaaaaaccuguccgcgaucgcacccgcgguugcaauuucaaacccgcacccgaaccgguuggguuucugguggguuucg

SEQ ID NO: 4184 - RNA, 72 nt, Zea mays
gucgaagccgacaacccgaugcagcacggcgggcucagccccgcugugucggccaucggguucucgcccggc

SEQ ID NO: 4185 - RNA, 79 nt, Zea mays; identical to SEQ ID NO: 4136

SEQ ID NO: 4186 - RNA, 63 nt, Zea mays
cacaaaaaggaggauagaccccaccugcaggucuaucagguggggucuauccuccuuuuugug

SEQ ID NO: 4187 - RNA, 115 nt, Zea mays; identical to SEQ ID NO: 4176

SEQ ID NO: 4188 - RNA, 91 nt, Zea mays
ggggagcucaggguguuugucaucgcgugaccugaucgcgcuugcggcgccguucugcugguccgugagauugccauccuucuuccucccu

SEQ ID NO: 4189 - RNA, 69 nt, Zea mays
gaugcaacugaagggucuucaaguugaugaacucuacucacuugaccuggaugcucucaaugaucuuca

SEQ ID NO: 4190 - RNA, 255 nt, Zea mays; identical to SEQ ID NO: 4177

SEQ ID NO: 4191 - RNA, 70 nt, Zea mays
ugagaucaaaucugucuugucugaauguuuugacaugaaagacaugggaccggcagauguaauccuaaau

SEQ ID NO: 4192 - RNA, 271 nt, Zea mays
cugggaaauacugcccuuucuccagccgacccuacauauacagacacuuugcagugaagauaagcauccacguccugccuggagacucgguaccaccgagugucucaaagaacgccgacgugucgaguuuugccuucuugaucuuggacagcgccgagagaauuuccggagcagguacuuuccucgucuuggcugccaccuugagcaccuucacacuguccgcgacagcagacagagauuccugcggggagggcgagggcgagggcgagga

SEQ ID NO: 4193 - RNA, 111 nt, Zea mays
ucauuuucagagguacucauugguuaagguucuggagacuucuacagaagaaggaaacacaucaacaaauucuugaugugugucaagccuuggaagugguggcgauggaag

SEQ ID NO: 4194 - RNA, 132 nt, Zea mays
aagggcuuguuugggagcaagugaaaugaaggggauugagggugcuagaaucccucacuauuuaaaauugaauagugggguauucuagccccuucaauccucuccauuacucuuccucccaaacaagcccua

SEQ ID NO: 4195 - RNA, 62 nt, Zea mays
ugaccagcagcggcuuaucuucgccggcaaggcagcuugaggacggccgcacacuugcugac

SEQ ID NO: 4196 - RNA, 57 nt, Zea mays
gggcugcugaagguguugggcuuggccagggccgguccugacauuuugggggcccua

SEQ ID NO: 4197 - RNA, 234 nt, Zea mays
acacacuagcucaggcucugcagaugauuccgcccuccuggccauucgccguaugggggguggauauccugggaccauuucccagggccgucgacggauacugguaccucuucgucgccaucgacaaguucaccaaguggccagaggccaccccuauagucagcaucacccagggugccgcugucgccuuccucaaguccaucgucuguagauuuggggucccaaguuguauca

SEQ ID NO: 4198 - RNA, 114 nt, Zea mays
gaccgcgccaccgcagcaccugguguucgccuacuacaucaccggccacggcuucgggcacgccacccgcgcccucgagguggugaggcaccuggucgccgcggggcacgacgu

SEQ ID NO: 4199 - RNA, 71 nt, Zea mays
cagcaagggagaccuggacuggaggaggaggaccuaccuacccggccuccagcuccagcucucucgucucu

SEQ ID NO: 4200 - RNA, 76 nt, Zea mays
accuugacaaaucuacaagaacugugguugggaagaaaucgaauucgagcugucaacuugugugguuugaagcuaa

SEQ ID NO: 4201 - RNA, 82 nt, Zea mays
cuaaaauuuggcaauuucugcgugugcaccagaccuugaacaaugucggucuggugcaccacuggaccuugucaaacugccg

SEQ ID NO: 4202 - RNA, 117 nt, Zea mays
cuguuuaaucuggcugaaaauagggggcugcugcacagcuuggagggugcuaauauccgaaacagacuguccauuuaugcugaugaugugguccuuuuuguucaaccuuuugaggaa

SEQ ID NO: 4203 - RNA, 75 nt, Zea mays
guuugaaguguuuuuuuagaugaguuggcguguuggaguaagguuggagcuaaacaucuugagaauuuaggccua

SEQ ID NO: 4204 - RNA, 94 nt, Zea mays
aaggcggcggcaguggagcuccucgcgcagugcaacggccgcaaggccaaggacuccaacccggccugcucggucgagcuccgccgccuccccu

SEQ ID NO: 4205 - RNA, 89 nt, Zea mays
cgccggcaagcagcuugaggacggccgcacucucucugauuacaacauucagaaggaguccacccuucaucuugaccugcgccugcgug

SEQ ID NO: 4206 - RNA, 646 nt, Zea mays
aaugggcagcagcgggcgucgucgucguuguucuccuccuccuccucuuccuccuuccucgucggcaagacgcugcugaggcaggccgaggcagcccggccgucguucgccgugcgcgccgcggcggauuccgacaggccgaucugguuccccggcagcaccccuccaccguggcucgacggcagccuucccggcgacuucggcuuugaucccuggggccucggaucugacccggagagccugcgguggaacgugcaggcggagcuggugcacugccggugggcgaugcucggcgcggcgggcaucuucaucccggaguuccugaccaagaucggcguccucaacacgcccuccugguacaccgccggcgagcagcaguacuucaccgacaccaccacccucuucaucaucgagcucauccucaucggcugggccgagggccgcccgcugggcugacaucaucaagcccggaagcgucaacaccgaucccaucuuccccagcaacaagcucacccggcacccgacgucggguacccuggugggccugugguuugacccgcucggcuggggcgccggcucgccggagaagaucaaggagcugcgcaccaaggagaucaagaacggacgccucgccaugcucgccguc

SEQ ID NO: 4207 - RNA, 184 nt, Zea mays
gcagcgacgagccccccggacccgcuauguuccugcacgccauggagcaccgcaugccagcccagcuggagggcaugcugcagucugcacggcgcggcguaggugccggccgccgcgucucgugccugguugucgaccuccuugcgucgugggcgauacccguggccgcgcgguucggccugcc

SEQ ID NO: 4208 - RNA, 71 nt, Zea mays
agggagauuuccaggcggucguggagcugugcggcugcucgcacgcguuucacgccgccugcaucgaugcu

SEQ ID NO: 4209 - RNA, 86 nt, Zea mays
ugaugggcacggacuccgguucgcguggggacgucgacggcccaacuguuaauucuaaccgucgucuacguggaguacggcccggc

SEQ ID NO: 4210 - RNA, 167 nt, Zea mays
ggagaagguggucgugcuggagggcgagaggacugagcuccggcgccagcuggcggaggagaggagggaagccaaucagguccuugccaaggcgcagucugcgcaggcggaggccaauuuggcgcggguggaggguagucucgccagccagcgcgccgaggaauggg

SEQ ID NO: 4211 - RNA, 86 nt, Zea mays
ugguguuccuugcuaccagugaccuacaugcagugaccuacauauaugcucagucuuuauuugggauccuggugguguugcgaaca

SEQ ID NO: 4212 - RNA, 137 nt, Zea mays
uagauaaaagcacuaaggacgagguuucaguugucaaaaagaguccaaaaugaggaaguucccauggcagaggaagcucuggcggugaacauuaucccaaccaauuuaggcaggucguucuugaugugaaaguugga

SEQ ID NO: 4213 - RNA, 248 nt, Zea mays
acgcuugauugaaaggguuuugugcgugcuugagucggaaugugugacagggcuggauauuuguugcucugggugcucgaucgaagagauuggaagaugauaggaaggcggugagaagaugaccagaugaguaugguuccccaaccaccgucacuauacuugguuuauaauugggagaggauucacgaaaaaguggauggaaacucugaguuugcauaaugcacaugaucacugucuugggcagucua

SEQ ID NO: 4214 - RNA, 148 nt, Zea mays
gaguaguauuagaccuuguucguuucuaccggauugaugggucggaacgauuucugaccagauugcuucucuaauuuauauaaacuuugauuagcuguaacgauuccggguguaauccgacggaaacgaacaaggccuuacuggaaac

SEQ ID NO: 4215 - RNA, 155 nt, Zea mays
cgccauagcaaggcuugcugaggcaucagauggugaaagugaggggcucaaucgugggcgaaggaacuuguaugcugguaaccagcaucaagcaaacuauguugaugacaugcccguuggugaccaagcugaucccauguaaccccugcaugaac

SEQ ID NO: 4216 - RNA, 66 nt, Zea mays
uggaguuuuacgaacaggauuacauauugagguuauaguaugucuguugggugucguguuuauuuu

SEQ ID NO: 4217 - RNA, 136 nt, Zea mays
agggggaggcggcgaggugacgugacgguugcgacuggcgccgaagacuugcgugagugguaacuggaacggaaucuuucuccucgacugcucggugcuggccucgccccuguugcggcgccgcucgugucccccu

SEQ ID NO: 4218 - RNA, 168 nt, Zea mays
cgacgguggagaugcggcggcaguggagagggaguguagaagaauggggcuacgagccgucggucagggcuaaguaaauguucuuugccgagugcccgcaaucuggcacucgacaauuuuuuuauucuauaacuuacuuugucgacuguccuggaucuaacacuuggc

SEQ ID NO: 4219 - RNA, 204 nt, Zea mays
aaccuccacgaccgaacgagcagagcagacccuucccccuccccagcuccggguuccagcggcggcggcggcggcgaagaugaucauaccggugcgcugcuucaccugcggcaaggugauugggaacaagugggaccucuaccucgaccuccuccaggccgacuacucggaaggggaugcucuggaugcuuuggaauuguuccg

SEQ ID NO: 4220 - RNA, 275 nt, Zea mays
ccacaguggaugcugucuuugcuaagaucgacgagcugcuggguucuauccuggagaagaaaaaugaaaugguguccagcacaugagcaaggggaauauaucugaagcacaggacgacacguacaaguaauguaagccagucucacguaauggaaauuucuccauguggauguggucaaagcauaggauuuuuuuucuccaauuguuaacuguacgcgaauggaagcgacagaucauucguagguugugagggcuucaaagaucaucugcugcug

SEQ ID NO: 4221 - RNA, 77 nt, Zea mays
ucaugucccuucgaucacagggucuucuccacagucuacacgucuggugagggcuuuggugcgucaguuuggaagau

SEQ ID NO: 4222 - RNA, 68 nt, Zea mays
gccauucuguguagugaagguacagugcaucgucugcagaugugcuugccuccuacagucucuuauac

SEQ ID NO: 4223 - RNA, 69 nt, Zea mays
ucgugggugagcggaucgagauggcggcgucggauguugagcaccgcugcuucgucugcggucucgccu

SEQ ID NO: 4224 - RNA, 64 nt, Zea mays
gauccgggccggcacuaccccccucggcgaucucgcugccggggaguuugugcucuucgucucc

SEQ ID NO: 4225 - RNA, 65 nt, Zea mays; identical to SEQ ID NO: 4118

SEQ ID NO: 4226 - RNA, 106 nt, Zea mays
gucgugcugcgcggucgcgucgacgucgaacgguguaacuccggcaaugcugucggacgguggugcaugaguuccggugaggcuccacggauggcggacgagcgac

SEQ ID NO: 4227 - RNA, 162 nt, Zea mays
cauuguuccagagccaugcuaugugaacauuacuaagguccgugcugauaaaggcuacaaaagcaugugcuuuuugugcgcaaaaauguuaaacuuucauaccuuuggaugguauauaccacuugucuuuaauucgucauaaauuguggcuuuguucgcuua

SEQ ID NO: 4228 - RNA, 75 nt, Zea mays
uccaugccuccuccauccgcgucuugguguggcucauggcggccucgccgaaccggaacagggucgccgcggagc

SEQ ID NO: 4229 - RNA, 71 nt, Zea mays
ugcggaggccagaugugcggcguugguugcugagaaggaggcacgugcggcuguugaaucugccacuauug

SEQ ID NO: 4230 - RNA, 258 nt, Zea mays
guccgucacggccgccgugcagcagcucaacgcugacccgcgccgcgccgcguccaugucgcagcuggggcaguccaagagccccuucuuccagcucuucaagcgcagcaaguccaacuccagcaacuucgccgacagcaugcucaagcucgugcgcacgcugcccaaggugcucaaguaccugcccuccgacaaggcgcaggacgccuggcuguacauccucagccuccaguucuggcucggcggcucggcggacaa

SEQ ID NO: 4231 - RNA, 217 nt, Zea mays
ucugcgauggugucuguagaugggaaggcauggugugcagcggcagcggccagguggugucgcugagccugcccuuuuacgggcucacuggcacgcucuccacggccaucgggggaccucucguuccugcguaugcugaaccugagcuccaaucgguuccgcggggaggucccagcgaccaucguucgccuugcgcaucugcaggcgcuagaccuga

SEQ ID NO: 4232 - RNA, 79 nt, Zea mays
cgacgcgaagcggcucaucggccggcgcuucucugacgcgucggugcagagugacgccaagcuauggccuuucaaggug

SEQ ID NO: 4233 - RNA, 109 nt, Zea mays
auggcgaggcggccguucuugaucuccuugaguuuguacuccuggagcuugaggguguccuuggagcuuggagaagucgagcgggucgaaggcgccgucgagguacuuc

SEQ ID NO: 4234 - RNA, 287 nt, Zea mays
ccacaguggaugcugucuuugcuaagaucgacgagcugcuggguucuauccuggagaagaaaaaugaaaugguguccagcacaugagcaaggaacuucuccaggggaauauaucugaagcacaggacgacacguacaaguaauguaagccagucucacguaauggaaauuucuccauguggauguggucaaagcauaggauuuuuuuucuccaauuguuaacuguacgcgaauggaagcgacagaucauuuguagguugugagggcuucaaagaucaucugcugcug

SEQ ID NO: 4235 - RNA, 123 nt, Zea mays
auuguucaaagagaugaagcucgcaugccaaugcgccacacauuccucugguuggaugacaagaguuguuaugaagaagagcagauucuccggcauguggagccuccccucucuacacuucuu

SEQ ID NO: 4236 - RNA, 61 nt, Zea mays
ugaccagcagcggcuuaucuucgccggcaagcagcuugaggacggccgcacacuugcugac

SEQ ID NO: 4237 - RNA, 112 nt, Zea mays
gcaagacaggcgagguacggaggaggcaauggggaaggcaaccgagcgcuggggcggagcgcgucgaacacguggcgcguugcuucugcccguguucuucgcucugcugagc

SEQ ID NO: 4238 - RNA, 105 nt, Zea mays
cggcccaucgugauguguggugcuucugacuucuggccccugcucagcuccaccaacacuaagccggggccagaucucagaagcauugugcaugauaugugccuc

SEQ ID NO: 4239 - RNA, 95 nt, Zea mays
gguucgggcuuaucggguucggguuuuucggguucgggauucggguaucggguuuuaugcccaggccuagcuccacgguggcccggucggaggac

SEQ ID NO: 4240 - RNA, 68 nt, Zea mays
cggcaccuggaaucgauacgacggggugguggccuccacgacuccccuuauuugucggaacaagucgg

SEQ ID NO: 4241 - RNA, 80 nt, Zea mays
acccaugcgucguuggcgaccgcgcccuucgaggcggacgaacagguucucgaggggccccuugccggugacuauggccu

SEQ ID NO: 4242 - RNA, 255 nt, Zea mays; identical to SEQ ID NO: 4177

SEQ ID NO: 4243 - RNA, 259 nt, Zea mays
gcagcuugaggauggucgcacccucgcugacuacaacauccagaaggaguccacccuccaccuggugcuccgccugcgugguggcaugcagaucuucgucaagacccucacuggcaagaccaucacccuugaggucgaguccucugacacgaucgacaacgucaaggcgaagauccaggacaaggagggcauccccccggaccagcagcgccucaucuuugccggcaagcagcuugaggacggccgcacccuugcugac

SEQ ID NO: 4244 - RNA, 285 nt, Zea mays
cccuucggggagagcacaaaaauauuugcauucguucaugggccagaucacgacagaaacgagugguguccaacacaauguccuggcacgcgggggggggguagcuagcuuaagacccuggugcgaacuugguggcguaaacccaggcuuuguuggcaacgggguccucaagguggucaagcagguucucgaggggccccuugccggugacgauggccuggacaaaaaacccgaacauggaaaacauggcgaggcggccguucuugaucuccuugaccuugaccu

SEQ ID NO: 4245 - RNA, 73 nt, Zea mays
cccccguuucguuuuaguugucgcugaauagugcaaaauugaacuauccagcgccaacuaaaaagaaacggag

SEQ ID NO: 4246 - RNA, 76 nt, Zea mays
aucaauaauucagccacguacgcuaccaucugcauauaugucaguauagguggcgcauguauugcuuuuaauaauu

SEQ ID NO: 4247 - RNA, 102 nt, Zea mays
aacgucugaacaggaagcguuacagaaggccaaauaugaaauauguugggccacaaugggucaacuaguugggccuuguaacuagcugugugagaauacgau

SEQ ID NO: 4248 - RNA, 70 nt, Zea mays
ugcuuaccugauguccucugcucaaccacaauugguacaugguuuagauggagaggacaucaaaagcuuu

SEQ ID NO: 4249 - RNA, 72 nt, Zea mays
aaucaggucggaugcucauguugugguccagucaguuguggcugaggggcacuuauggugucuggcuggggc

SEQ ID NO: 4250 - RNA, 113 nt, Zea mays
acgacggggacgccgacgccgacgacgcugaggccgaggccgaggccgccgugccgaugucauaugugcucgacuucggcuacggcgucguaccgagcuuuugaugugcccgg

SEQ ID NO: 4251 - RNA, 108 nt, Zea mays
agaguuguuaucuggcacuaacuaugucacagccaacauuuucuuucccaaaaucaccaauauuuauuuggcaauuaggaaguggcaaguaagugcuaacccaaaggu

SEQ ID NO: 4252 - RNA, 121 nt, Zea mays
gaaauuggagguacggcugaggaggaugcugcaacguucauccaggaaagcaaaacacaaaagccuguuguugcauucauugcuggacuuacggcacccccaggccgucgcaugggucaug

SEQ ID NO: 4253 - RNA, 106 nt, Zea mays
gguacucuuggauugaagugguuuagagggauugaagaguguuuaaauccccaauagaucaaaaacuccccuaauacaucucaauccacuucaauccgucucauuc

SEQ ID NO: 4254 - RNA, 89 nt, Zea mays
cggaauagaccaggauuuauuccugcucaucaaaaucuauauaaauuagagaaguaauccggcuaggaaucaauccgggccuccaaucc

SEQ ID NO: 4255 - RNA, 95 nt, Zea mays
gacgaggacgucagguuccaggaggcggccaggaagcaggacgccaucggcgaguccucgagcaccgccccuuggaccuggcacaagaaacacca

SEQ ID NO: 4256 - RNA, 84 nt, Zea mays
agccaguuaagccccuccauuuuagucucauuuagucucuaaauugcuuaacggugggacuaaaauagggacuaaauuguuuua

SEQ ID NO: 4257 - RNA, 255 nt, Zea mays; identical to SEQ ID NO: 4177

SEQ ID NO: 4258 - RNA, 117 nt, Zea mays
gguauagagggauugaaguggauugagguguauugaaggggauugaaagaaaaauuaguucauauuacacuucaauaccccacauaccaccucaauccacuccaauccgagauuacc

SEQ ID NO: 4259 - RNA, 303 nt, Zea mays
guccaucauuuucucacuccuuacuuuuuuuauuugguuuguguaaugaaauguguugauccaucaccacccuauuccuuauaguuaguuacuuaguacuaauauaugguguguuugguuuguagagucacucuauacuccaugagaugaugcaucauagguucauuccauuaauuuugguagaaucaacucacuccucauuuauauacuaauuauuaguuuauggggaaugaggugaugaugaaucaacccacucuauucuacaaaccaaauaaaaaagugaggaguaagaagaagaugaau

SEQ ID NO: 4260 - RNA, 85 nt, Zea mays
guguuucagugcaaggggugcugugagcagcacgcagugugugcucacaucagaugcuggcccagacacucuuguacguccgaac

SEQ ID NO: 4261 - RNA, 217 nt, Zea mays
uauuguuguaauguuguggagcggagguuugcugguuguuugguuguugcaacuuuauuuucuuauuugcacuucuucacuugaacauguuaauuaaugucaacuaucuacuauuuguuauauacuuguggauuuguggauuaugccuaaaauaggggaaaugcugccgaauuuuuuuaauauuaguaacuuugaacugcaugauguuaaaagaaaa

SEQ ID NO: 4262 - RNA, 76 nt, Zea mays; identical to SEQ ID NO: 4200

SEQ ID NO: 4263 - RNA, 75 nt, Zea mays
caaagcguuugaggcgaugcagcuuggcggagaccgacgacggcgucugagaucugaucgcucuuuuccuucccc

SEQ ID NO: 4264 - RNA, 65 nt, Zea mays
aguuagauuuuagcugagcauugguaaugagaaauacaauuuaaaguucagacuaaugugugaca

SEQ ID NO: 4265 - RNA, 373 nt, Zea mays
gcggcggcggcggcacgucggugguggugaagauggagagcccggacugggccguccgggagccagaggcggcgagggggaaggccggccgcggcaagaacgcucgccagaucacgugggugcuucugcucaaggcgcaccgcgccgcggggaagcucacgggcgccgccuccgccgcgcuguccgucgccgcggccgcgcggaggcggguggcggcggggcggaccgacgccgacgccgacgccggcgccggcgccggcgccgcgccgcacggggagagccccgcacugcgcaccaggcucuacggcuuccuccgcgccucucucguccucuccaugcuccuccucgccgccgacgucgccgcgcaccucca

SEQ ID NO: 4266 - RNA, 218 nt, Zea mays
cuuucuuccaugcagaggcaaccuaagauggacagcuuacaagaucucucgauuuuggaauuauacauucuugugugcaugcacagauuagaaaguaaggagcaaaccucauacaacuucaccagcauaaugaaagaauacagauccauacaagacgccuauaagacuucugauaaauaugcaagcaccguuuguuuuagggccuuugagcaccuuuu

SEQ ID NO: 4267 - RNA, 218 nt, Zea mays; identical to SEQ ID NO: 4266

SEQ ID NO: 4268 - RNA, 119 nt, Zea mays
acgacggggacgccgacgccgacgacgcugaggccgaggccgaggccgaggccgccgugccgaugucauaugugcucgacuucggcuacggcgucguaccgagcuuuugaugugcccgg

SEQ ID NO: 4269 - RNA, 88 nt, Zea mays
ggagugucaaggccauagcacucggcaaagaaccaagaccuggacaccgguauagccucuuugccgagugcgguggcccuggcacucg

SEQ ID NO: 4270 - RNA, 81 nt, Zea mays
  misc_feature (47)..(47): n is a, c, g, or u
  misc_feature (72)..(72): n is a, c, g, or u
  misc_feature (80)..(80): n is a, c, g, or u
cgcaccgaagagagaggaggcgagcaugaggagcaugguauacuccncccaucucccuuccuacuucucgcnccuacuanc

SEQ ID NO: 4271 - RNA, 90 nt, Zea mays
aauuacacgcacgcgcgcuaucucucgaucgugaagaagagagauugcuagcuuuauuccgguccgacgaugauggacgcacauauauau

SEQ ID NO: 4272 - RNA, 180 nt, Zea mays
uggccagguugcuccccggguggaagacgcugcgccacacguugccggcgccgcgcggcgucgucgacgacgacgacgacgacggcgucaccggcgucgucggggucgacggcaucgacugcgcccgcuuguagcugccgccguccgcgucuuugccgucuccgggcgaggcccggccac

SEQ ID NO: 4273 - RNA, 181 nt, Zea mays
ugucccagcuuaccgccguuggucaugcugcuauuuuggcuuucauccagagauaugugccaucgaugaucccguccacauaugcccccgguagguuggaucuccuuaggcagauugagaagguuaaggaaauggaaguugcugaaggcagcagugaagauauauuggaggaacugaacaa

SEQ ID NO: 4274 - RNA, 73 nt, Zea mays; identical to SEQ ID NO: 4114

SEQ ID NO: 4275 - RNA, 78 nt, Zea mays
ucgugggugagcggaucgagauggcggcgucggauguugaguaccgcugcuucgucggcggccucgccugggccacgg

SEQ ID NO: 4276 - RNA, 63 nt, Zea mays
guucguucguuugcugacguguucucuuccgauccgccgaaacgcgugugcaggcgagcacag

SEQ ID NO: 4277 - RNA, 171 nt, Zea mays
ggcggcugguggggcgguuccaggugugcgcggugugcaccugcugcgggggcccgcacgggaugugcaucccggcgccgugcugcuacgccaucaacugcaacauccccaaccguccauucggcgucugcuccuucaccccgcgcaccugcaacugccucaauugccacc

SEQ ID NO: 4278 - RNA, 106 nt, Zea mays
cggcucggcggcgccauggcaguucaccggcuccaaccuucccccuccggccuacagugcuccaccgcccggucgccagugcuccuccaugggccacggcugacgg

SEQ ID NO: 4279 - RNA, 242 nt, Zea mays
aagaacggccacggcgcccagcagcaccacgaccgccagcaccgugaacagcacuaccgccgcccacuccgccgcgcccgaccggugccuccugaagcuguaccgucguggacgcugaggcuccuccuccucgcgcccccuccacgucugccauuccgccggcuggagagcgccgcggcggccggggcucugcugcucacgggcgcgcgggucaugggccgcguggcugccgccgccgccag

SEQ ID NO: 4280 - RNA, 76 nt, Zea mays
aaguuaugguggugcacaugcauagccgucugaggucuuugagacaaggucaagugcaugugggcccaauaacuug

SEQ ID NO: 4281 - RNA, 124 nt, Zea mays
uucucccggagcaucuggcagcaagcagucuggcaaaauugcaaaugaaaaggagaguccuaaaguugauccuagagguauauuccauggccaugacaguacuguugaagauguucaguucugc

SEQ ID NO: 4282 - RNA, 63 nt, Zea mays
acucggcaaaguccugcuccugauaacgaccguguuuaucgagagcaggacucuuggcacaga

SEQ ID NO: 4283 - RNA, 74 nt, Zea mays
caaugccgccgcgcguacccggcgcugcccuugacagcgucgacgaggaggcgccggcgauggcguuggcgugc

SEQ ID NO: 4284 - RNA, 105 nt, Zea mays
aaagucagucuacucccuccguuuuuuuauauuugucgcguuuuaguuaaaaauaaacuagaagacgacaaauauucgagaacggagguaguagaagcugucuac

SEQ ID NO: 4285 - RNA, 449 nt, Zea mays
aaugaagaguagcacugauuauuguuacaugacgaagguugagcauccauggaggcuagauuauagacagacacccugauuuuacaugacgaaucgcaagaagcgcaugcauuggauauccuuagccggagagggcgcugguguuguagacgaggagggcgccgccgccgaggaucccagcgagggugacggcccagaucagaagcguuccccuccugcacgcaaccucaucucguccuccagauccaggauggccguccuccuugagaccuugccuccccgagugcucucggugagcuacuuuguuucgauuuaucaggaaauccguuugcuucauguugugcaggcucauaucugauugcuggauucggcaaacccgcguuggauccuguaucgguuaguccuugccugcaagguucuuguuguuuuguuuugguggucgagcaucg

SEQ ID NO: 4286 - RNA, 181 nt, Zea mays
ccaauucuauuguuuggaugucacugaauuggaguuuggaauugugcggucuaauuccacgcaauaccguggggcgaggcuuuguauugggagaggggguuucuagucauaguccaauuccagggaauugggccucuaauuccaaaucucaauuccacgugcaaccaaacaacauaauuua

SEQ ID NO: 4287 - RNA, 79 nt, Zea mays; identical to SEQ ID NO: 4136

SEQ ID NO: 4288 - RNA, 59 nt, Zea mays
gaugagcucgcuggagacgcgcguggagcuauuccauguggaucugcaggaggagaagc

SEQ ID NO: 4289 - RNA, 73 nt, Zea mays
aucgucaguuuuacuugaugugaagccauucuacgaugacacugacauggccaagcucgaggaagcuguuagg

SEQ ID NO: 4290 - RNA, 69 nt, Zea mays
ugaugauaugauggcucaaagguuaggggcuguuuucaugccucauggucuuggccacuuacuugguau

SEQ ID NO: 4291 - RNA, 111 nt, Zea mays
ugcucucaauccauguagauugggugggauuggauaaguuucaaucccaaacaagucaaaaucuuuuacaauuuuuuccaaucccauccaauccaccaugggauaggaaua

SEQ ID NO: 4292 - RNA, 220 nt, Zea mays
uguaaacuccacuagcgcgagugcuuggucuacuuccacuagaagcuuaacugaaauagcucuuuaaaguuuuuugguccauauucuuugccuuguuuuuguuuauauccaagacugcuauuuagaaauuggaaaaucgagugcgaggcuccgagcggcuggaggcuggagcgcccggcaggagcggccggcggccgagcgggcagcugugcgggacgcg

SEQ ID NO: 4293 - RNA, 107 nt, Zea mays
cucuaccccggcggccaguacuucgacccccucggccucgccgacgaucccgucaccuucgccgagcucaaggucaaggagaucaagaacggccgccuugccauguu

SEQ ID NO: 4294 - RNA, 65 nt, Zea mays
acgcguucgcgcuguucguggcggugucggugggcgcgaacaucuccggcgggcacgugaacccu

SEQ ID NO: 4295 - RNA, 62 nt, Zea mays
uccaugggagaugaauccauugcuauucaaauugaauagcaaggggauuccuccccauggau

SEQ ID NO: 4296 - RNA, 65 nt, Zea mays; identical to SEQ ID NO: 4118

SEQ ID NO: 4297 - RNA, 334 nt, Zea mays
gaugaccuugcaaucauaauuguucucuuuguaauuugucucuggagacagcgauacaucuuuguaaggauugcaccuucgucgaggaaguguggaacaugaucuugucuugggcugaucuucgguuccuugucgguauuucaaagacgggaacacuacacacaugguggcuuagacugaggacgcucuguagcaagcaauuaagaaaaaguuucgacggccuucgacgaccuucuaauuuauuucugguggagcuuaugguuggagagaaauaaccaaaucuucaagggucaacaaagaacgacagagcaaguggugcagguggugaaagauc

SEQ ID NO: 4298 - RNA, 233 nt, Zea mays
gcggacgagaagaacugggacgggauggugauggcgugcgagacgccggugcugguggaguucugggcgccguggugcgggccgugccggaugaucgcgccggugaucgacgagcuggccaaggacuacgccggcaagaucaugugcugcaaggugaacacggacgacagccccaacguggcauccaccuacggcauccgcagcauccccaccgugcucaucuucaagggcgg

SEQ ID NO: 4299 - RNA, 123 nt, Zea mays; identical to SEQ ID NO: 4235

SEQ ID NO: 4300 - RNA, 151 nt, Zea mays
ggguaaaacgcuggacguuaaagaugguggaguaaagaaaaagaagaagaaguaccagcgugaggagucgucucagacugaauaugauaagaauggagaugaagaaaacucacaucuugacuaugaccaucucacaccagcagagcgccga

SEQ ID NO: 4301 - RNA, 61 nt, Zea mays
ugguuugaguagcacuuccuggguucgacuccccgugggagcgaauuucaggcugugguaa

SEQ ID NO: 4302 - RNA, 68 nt, Zea mays; identical to SEQ ID NO: 4240

SEQ ID NO: 4303 - RNA, 212 nt, Zea mays
accgacgcucgugggacaugcagaggaagaugagcgcagguguggacgaggugccggacuucguguuccuggcgcacgugguggacgugaugcagucgcugcacgugcccuucgucaugcggaccuucgccuccacgcccuucuccgugcagcucuuccugcugcccauguggcccuucgccuuccucgucaugcucgccaugugggucugg

SEQ ID NO: 4304 - RNA, 171 nt, Zea mays
ggcggcugguggggcgguuccaggugugcgcggugugcaccugcugcgggggcccgcacgggaugugcaucccggcgcccugcugcuacgccaucaacugcaacauccccaaccgccccuucggcgucugcuccuucaccccgcgcaccugcaacugccucaccugccacc

SEQ ID NO: 4305 - RNA, 125 nt, Zea mays
cuuucuuccaugcagaggcaaccuaagauggacagcuuacaagaauacagauccauacaagacgccuauaagacuucugauaaauaugcaagcaccguuuguuuuagggccuuugagcaccuuuc

SEQ ID NO: 4306 - RNA, 95 nt, Zea mays
aauaaaaaauggagaggcucuauucuguuugcuaaacacggaauagaacaacucuauuauaaaaaaacuagaauggagccguuccauuuuaguug

SEQ ID NO: 4307 - RNA, 96 nt, Zea mays
gguagcgagcuguacaucauggagcaguuguuugacuacaagaugguugagaaccguccuguaguugaacaggcucaugaaauacaugcacuggcu

SEQ ID NO: 4308 - RNA, 188 nt, Zea mays
uugggaaagugugaacuaaaucauguaucauucugauuaguaguguaguguaacaaaauacaacuuucaggggagagugcuuagaucauuuuuaucgguuagcuauauuagaugauuucaaaguugacugcaaacuuugucauggagcaaaacuuaggugcuguuugguucacgaaauauaacguaaa

SEQ ID NO: 4309 - RNA, 90 nt, Zea mays
uccucaaauggaucgucuguagauuuggggucccaagccguaucauuacggacaacaggacccaguuuacaagucggaucuuccaggaau

SEQ ID NO: 4310 - RNA, 192 nt, Zea mays
ugcggaaguguagugcugcuggguuggauguucucucuaauguguuuggugacagcauccuuccaacuuuaaugccauugauugagcaaaacuuggcucgaacagaugaugauucuuggaaggagagggaaacugcuguuuuaugucuaggcgcuauagcagaggggugcauuaguggucuauacccacacc

SEQ ID NO: 4311 - RNA, 79 nt, Zea mays
cccaggccacacggcucacuugucggugcgaugcaugaacgcccuguaucgucugcaagugaugcguggagaggcaaua

SEQ ID NO: 4312 - RNA, 127 nt, Zea mays
gguccaugcccgugcugcaccaugcucacagggucgcccuccuggaaccaggaggaaagggcaugucgucugggccucuggggccagggagcagcgccgagagaguggaagcacggagccgccguau

SEQ ID NO: 4313 - RNA, 101 nt, Zea mays
aagaggaacaugcuacucaucuucggguggugcugacucgacuucgggaacauaaguuauaugcuaaauucaguaaaucagaaggaguagccguggauccu

SEQ ID NO: 4314 - RNA, 90 nt, Zea mays
gcgugguccgaccgagguggagaauuagcucggcucgucucauuuaugagcuugaguuaacucguuuagcucgcgaaccaugaaaaaaca

SEQ ID NO: 4315 - RNA, 73 nt, Zea mays
uaggauccuuggaauugugagcaggagcuugguagugccacaggucuugaugacaaucuucagaggauagaug

SEQ ID NO: 4316 - RNA, 105 nt, Zea mays
gaaauaugcagcagccccgauggcuccgcgugcugccggcuuguuguuuuauugcgcagugagcagcacaccgugaugcccgucggugguuugcuauuuuugcgc

SEQ ID NO: 4317 - RNA, 62 nt, Zea mays; identical to SEQ ID NO: 4295

SEQ ID NO: 4318 - RNA, 63 nt, Zea mays; identical to SEQ ID NO: 4276

SEQ ID NO: 4319 - RNA, 218 nt, Zea mays
cgagaucaucacggggaagggcgcgcuggcgcagcucaacaucgagacgggggugcccaucaacgagauagagccgcucgucaucuucaacguccucuucuucuucaucgccgccaucaaccccggcaauggcagguucaucaucggcgaggaagaggaauaggcugcuggccucggacaugagucgugugcguuuacuuuuaccugugacugugagu

SEQ ID NO: 4320 - RNA, 65 nt, Zea mays; identical to SEQ ID NO: 4118

SEQ ID NO: 4321 - RNA, 87 nt, Zea mays
agcggcgcugaagcuucugauugagcaguguugguccuggcaaccagaaaagaggcccgacuuucagcagauaguuucaauccucga

SEQ ID NO: 4322 - RNA, 79 nt, Zea mays
ccgucgccgucgccgucgggcuuggucuggaacuugguguucuccuugaucccggucagccggcuggcgaaucuggaag

SEQ ID NO: 4323 - RNA, 78 nt, Zea mays; identical to SEQ ID NO: 4145

SEQ ID NO: 4324 - RNA, 124 nt, Zea mays; identical to SEQ ID NO: 4281

SEQ ID NO: 4325 - RNA, 97 nt, Zea mays
ccucaaguccaucgucuguagauuuggggucccaaaccaaagggcaaaugcagagauccucaagggacucaagacaugcaccuacgacuacuugaag

SEQ ID NO: 4326 - RNA, 467 nt, Zea mays
uauauaugcccccuccuauaucgucgucgaagcuaucauccccuguucgacccccaccucacuagcucgcucuaaacacgauccugucgucguuucgugugucgucaagaaaucccaagcgucggaugaagacguagccaacagcgcgauauuccccaagcgcucgacaaauuugcuggaucggaaaaucacuaccgaucucgcggauucgugucagcuguggaaacggugcgauaauuaaucacgugaugcggaagaugacucaagucgaccccaagcgcgggcuacuccgcauggagaugcugaugaacgaaccugucugaucaaguguuaggacaaggaugaucgucaaguggaugucaucuaacaaacacuaacauaguguuacccaggagaagaacaggugguagaagaggagcagccuaacacugaggcuuucgacuugaucuagguagcguuuccccagu

SEQ ID NO: 4327 - RNA, 333 nt, Zea mays
accgguucacacuuucacgcucagcuucagcaauggcugccuccacgcauggcgaucgccuccacggcgauggccggcacccccaucaggguggguuccuucggcgaggggcgcaucaccaugcgcaagaccgugggcaagcccaagguggcggcguccggcagccccugguacggccccgaccgcggcaaguagcucggccccuucuccggcuggcccccgagcuaccucaccggcgagauccccggcgacuacggcugggacaccgccaggcuguccgccgaccccaagacauucccuaagaaccgcgagcuggaggugauccacucccgg

SEQ ID NO: 4328 - RNA, 100 nt, Zea mays
cugacggauucuuugccgaguguuggccggcagacacucggcaaagauaacuccuuugccgagugucaccuaagacacucggcaaagacgccgucuccgu

SEQ ID NO: 4329 - RNA, 110 nt, Zea mays
aggcgguaccacuacuccggcgccgcgugcccggacuuccgcaagggcgggugcaagcgcggcgacgcgugcgaguucgcgcacgggguguucgagugcuggcuccaccc

SEQ ID NO: 4330 - RNA, 154 nt, Zea mays
  misc_feature (112)..(112): n is a, c, g, or u
  misc_feature (132)..(132): n is a, c, g, or u
cuaaauuuagggugcguuugguugcgggacagucagcacacggacguccucugucguccucucucgucccuccaauuuugagggauagcuggggacaacacugagauaguunugucccaacccuugaccuungaccaaacaaccuuauuugagg

SEQ ID NO: 4331 - RNA, 61 nt, Zea mays
ccgcgguugucgaucggccgaaugauugauugaucgaucgaucggucgguccaccgcggca

SEQ ID NO: 4332 - RNA, 104 nt, Zea mays
gggcggcggaguuugcuggcagugucuggaucucgcucccggaagggacccgucggggagaagauuuugucuugagaccggcaggccacccaagacgccucuaa

SEQ ID NO: 4333 - RNA, 82 nt, Zea mays
ccggcacccgccgcccucccgcgccgccgcccggcucgcguggccgucgccgccgcggcgccggagcgcaggccgccgggcg

SEQ ID NO: 4334 - RNA, 87 nt, Zea mays
cgggucggcccugacuccuuaacgugcacugcccacucguucuugcuuugugcagcccacgauugaugcgggcgccgaccuaugggu

SEQ ID NO: 4335 - RNA, 156 nt, Zea mays
aagcccauucucuaccaaagacagaguggccuaagucaccucucucacauaguacacgcauguacaauuguggagauucuauacaggacaugcugauagagaaggaauaccauguugaucuuguuggccaugcuuuuaaugauagggaacugauug

SEQ ID NO: 4336 - RNA, 318 nt, Zea mays
gacacugcuuaguggccuggggaagaguguguagaccuauugaauugggaggacuggggguuuucagccuuaaagagcucacuugggcccuacggaugagguggcuauggcuggccaaaacagaccuugauaagccuugggccuuccugccuaugcagguaccggagaaggugaagucuuucuucucuugugugguacagacugaaauuaggaaugguucaucaaccuuauucuggcaagaccguuggcuucaaggaaaaagaauucaagaccuuggucccaauuuguuagcaguugucccuaaucauauuaagaaaa

SEQ ID NO: 4337 - RNA, 120 nt, Zea mays
ugccacguguucggcgaucuguccaagugggguguugagcagugagcagcaagccgucaacgcccgccgugugcucgcuguuuugcgcagcccauccgcgacgccgucgaaaaccgugcu

SEQ ID NO: 4338 - RNA, 144 nt, Zea mays
gccagaacggugccggcgguggauuggcugcagcggaccagaggagaaguggccucaaaucucugcauuuccucgcuucuauccuacucaagaagauggggcccaguggcacgcgcuaccuucuaugcuugguauuaacaucgg

SEQ ID NO: 4339 - RNA, 69 nt, Zea mays
ccaacucuaagggcuaguuugggagucacuuccgguuuuguggcucccaaacuagcccuaaaaggcagg

SEQ ID NO: 4340 - RNA, 227 nt, Zea mays
ucaacaucaccuaggguugcugcuguugcuuuccucgggucgauugucuguagauuuggggucccaagccauaucauuauggacaaugggacccaguuuacaagucagcucuuccaggaguauugcgagggcaucgacacccagcucugauuugugucuauggcucaucccaggagcaacggccaaguggagagggcaaacgcagaaauccucaggggacucaagac

SEQ ID NO: 4341 - RNA, 242 nt, Zea mays
gcaucagauccaguccucacagucccugcugauccaguacgaaauccgccuucccccucuccccagucuuuuguuucauacugugccuucuaauuuauuucugguggagcuuauggguggagagaaacaacagaaucuucaagggucaacagagaacgacagagcaaguugugcagauggugaaagauuuuguggguagagguauggccugcuaguaguguccgggggacuggucagggggu

SEQ ID NO: 4342 - RNA, 73 nt, Zea mays
acaaggggcgcggguuucgacgacgacgcgcagacgcugcgcagaucgacgacgugaggcccgaucuagcgag

SEQ ID NO: 4343 - RNA, 73 nt, Zea mays
ucgaccacgaacagcguggacgacgacgcgaaguacuccgacuugccggcgucguaccacugcggcgcguuga

SEQ ID NO: 4344 - RNA, 93 nt, Zea mays
uggauguguuaguccugaugcaggagccuguuguuccugguucguuccugcgagcaagagcaaucggccuuaugcccaugauugaccagggug

SEQ ID NO: 4345 - RNA, 63 nt, Zea mays
caacugcccacgugucacacccgguuuuggaaggaaaccggaugugaaccaugucgugccagg

SEQ ID NO: 4346 - RNA, 69 nt, Zea mays
gccguccccggcgccgcggcugaccgaccuguggcaguccgcgggcgaguucugcggcucgcugggcgg

SEQ ID NO: 4347 - RNA, 84 nt, Zea mays
ucccagaaguuguguuugguucagcuuccggcuucuggcggccagaaucuccccagaagcugaaccaaacaggggcguuguguc

SEQ ID NO: 4348 - RNA, 75 nt, Zea mays
gaucaacgcgccgcagugguacgacgccggcaagucggaguacuucgcgucgucguccacgcuguucguggucga

SEQ ID NO: 4349 - RNA, 107 nt, Zea mays
gcgucguacaccucggccgccgccgugccccgggcgccggacagcgagcacugcccgccggccacgcagauccggccccggcacggcgcgcacgcgaagucgaaccg

SEQ ID NO: 4350 - RNA, 156 nt, Zea mays
auagacuaaagggccugcucguuucugucggaauucacuaggaaucguuccagcugaucgaaccuaguauaaauuagacaaauaauucggcuaguaaucucuaguaaucguucugggugucuauucccuaggaaccgaacaggcccuaaacuguaa

SEQ ID NO: 4351 - RNA, 83 nt, Zea mays
cccagaucuucagcgagggcgggcuggacuaccuuggcaaccccagacugauccacgcgcagagcauccucgccaucuggggc

SEQ ID NO: 4352 - RNA, 126 nt, Zea mays
gacggccggauuaaguucgacgguguccaugugcccgacgaacuuaacuuaagaacguggguggacauauuuguuugccggaagauggcaaaaaacaugggauuucuaaagcuugaaguuggccuc

SEQ ID NO: 4353 - RNA, 69 nt, Zea mays; identical to SEQ ID NO: 4346

SEQ ID NO: 4354 - RNA, 81 nt, Zea mays
ucuggugcacauaaaaaauuggugcacauggugaugauuuaauaugugcagcaugugcaccaaucuuccaugugcauuaga

SEQ ID NO: 4355 - RNA, 169 nt, Zea mays
  misc_feature (166)..(166): n is a, c, g, or u
ccugcgucagggacuccugccgccgucgccgugcagaugccaacgacaugaaggccugcuacgggcagugcuacgaccgcugcgagaccaaggccggccugccgaggccucuccgcgcaggcggcggcguuggcauugucuggccggcggcguugcccgaccaccnauu

SEQ ID NO: 4356 - RNA, 108 nt, Zea mays
uuggugcaggggcucgagcacgggcucggucggcuccaggcggagacgcgcucggcggcgucagguccggcuggggcggcuuggacggggcuuuggcucuuggucggg

SEQ ID NO: 4357 - RNA, 261 nt, Zea mays
cgcgcgcggcggaugcuggggcgggacugccagcugaugggccucacguggcuucuggccaagaacagacggccuacauccccaccgucuccgccgugcugcgcgccaugcucuacaccgcgcgcccgacggaguccggcagcggcggcgcggcgccgcggugcagccccgaccaggagaacaugccgcuugccguggacucucugcaguucgagcgcaccgccagcgcgggcgguuccgcggccgccuccgcgacgccgc

SEQ ID NO: 4358 - RNA, 71 nt, Zea mays
guucacgacgaugcaggcgacgguggcggcgcgcaacccgcgugugguccccguuccugcgcgccccggac

SEQ ID NO: 4359 - RNA, 233 nt, Zea mays
gacgggucgccgucgguggugguggcggcggcggcggaggaggaggaggaggaggauaagcugugguggcucaaggagcgcgcggcggcgacggggucgcggcugccggacugcgcgcacgcgugcgggccgugcuccccgugccggcgcgucaucgugagcuucaggugcgcgaugcaggccuccgaguccugccccgucgccuaccgcugcaugugccgcggcagguucuu

SEQ ID NO: 4360 - RNA, 113 nt, Zea mays
aagacaccgccauccgcaagcugcucgacgaaaugcgacucauggaggugcgccuguccgagcgcaucagcggauguugcgauggcgucgagcgcugccgggacgagcguugu

SEQ ID NO: 4361 - RNA, 80 nt, Zea mays
ugccgugcucgccguccagcaggaucuccggcuccacgaucggcacaagcccguuguccugugagauggcggcguagcgu

SEQ ID NO: 4362 - RNA, 75 nt, Zea mays
ggaaaugagggggggggggggggggccauguuuauacccccgaacggcccggacccugucucaccucgaggcgcc

SEQ ID NO: 4363 - RNA, 132 nt, Zea mays
gcaauacuuagggcuaguuugggaacaccauuuuccuaaaaaaauuucauuuuuacaagggaaaaugagcuaauuucccuuugaaaaaugaaaaucccuugaacgguguuucaaacuagcccucaauggcug

SEQ ID NO: 4364 - RNA, 793 nt, Zea mays
uccaccccggcgccgccuucucgcgcccgcgguaccggcggcggcucgguaucugugucggugucgguguccguguacauggagaccgcguacccggugcugagcauguucgcgcugcuguuccugcaccugcuccucuacgggugcaacaugguggcguggcgcaggugccgcgucaacuacggcuucaucuucgagucgucgccgucgcccgccggcggggagcucgggccccgggacguguuccucgucugcgccgcguccauggccgccgucgccggcgucauguucgcgcaccucgcccucgugcucagguggggcuaccacgcgucgccgcacguggaagccauccccgcguucuugcuccugguguuccugcugcugcuguucugcccgaucaacgucguguaccgguccagucgguuucaguuccucaggauacugaggaacauuguacugucaccgcucuacaagguuguaaugguagacuucuucauggccgaucagcuuugcagccaggugccuaugcuacggagccuggaguaccuggcgugcuauuacaucagugggagcuacuggacgcaggaguacggcuacugcaccaacaccaagcacaucagagaccuggccuacgccgucuccuuccugccguacuacuggagagccaugcagugcgcacggaggugguucgacgagggggacacgagccaccuggugaaccugggcaaguacgucuccgccaugcucgccgccggcgccaaaguggcguacgagaaggacaggagccuggcgu

SEQ ID NO: 4365 - RNA, 165 nt, Zea mays
ccacgaacguuggcgcgcaagcucguggugugagcggucacugucucccaucccauggcuccggcgcugagcgggacucugggcgcgucgucgguggcggcgcugcggcccugcgcggggaggagggcgccguccgccgcgagcucgguugcgccgcgcgggagc

SEQ ID NO: 4366 - RNA, 65 nt, Zea mays
gagacguucgcgcgcaaccgggagcuggaggugauccacuucccggugggcgaugcugggcgcgc

SEQ ID NO: 4367 - RNA, 174 nt, Zea mays
cuguaauaugugggcuugugcaugugcuuggcguauugcaugcagugaauaauuuaucuucgcguuggguuggugacaauguugggaacggauuugaauugggguuuaugcuugccaucuccucauaucucgaacucagcugcuguuucacugaguaauguacauuucccuggc

SEQ ID NO: 4368 - RNA, 73 nt, Zea mays
ucuacauguauugagguggauugagguguaaauuaguuuaacuuacacacuaguccaccuuaaugcaugugaa

SEQ ID NO: 4369 - RNA, 284 nt, Zea mays
gcgggagaacguggcgaagcaggugcccgcgcagaacggcaagacgcacuucgacgccggcgacgagcgcgccaaggaguucgcggcccugcucaaguccaacgaccccgugggcuucaaccucgucgacguccucgccuggggcucgcucggccacaucgucgccuacuacauccucgccaccuccagcaacggauacgaccccaacuucuucugagcggucgucgaggauguauucuacagacagccgugugcgugcgugugugcuugucauguauccgauc

SEQ ID NO: 4370 - RNA, 69 nt, Zea mays
guaaaccaaguagcaacagacgcuucacuucacacuauacgaauuugucgucuguucuaucgaucagau

SEQ ID NO: 4371 - RNA, 253 nt, Zea mays
uggcgccgccgcagcaccagcaccagcaccauccgccgccgccguucgcgcagcaggcggccccgguuccgucgccugccgcguccaugcccggcggcaugcggcucucguucgaccagauguccgggaaggcgcccggggagcagcaccaccacuccgcgcccaugcuguacacggugccaccaccgcaguccgccgcgggcgcgggcgcaccgggggccaaugugcugggcaugggcgagcugaugcgcaa

SEQ ID NO: 4372 - RNA, 87 nt, Zea mays
gaagaaccaaugccugaucgauggcggcccagcuuguccucuccgcucggcacgugcugggccgccccgcgcagucaaccgugucua

SEQ ID NO: 4373 - RNA, 139 nt, Zea mays
acuguaacuacauugguaccggcucuagcgacaaaacuguaagacuaugggauguucagacgggugaauguauacggauguuuauuggucauaggaguaugguuuugucacuggcaaugucaccugauggacgauacau

SEQ ID NO: 4374 - RNA, 102 nt, Zea mays
gguggugcuccugggagucugggaccggcuggugcgccuucgcgcgcggcaacugccucgaggaaggggacuacugcgucuucgagcuccuggacguagcag

SEQ ID NO: 4375 - RNA, 68 nt, Zea mays
ggacaaaauacucgcggcucgucggcucguucgguguggaggggucgacgagcuggagagaugcucau

SEQ ID NO: 4376 - RNA, 250 nt, Zea mays
auauucuggucaggggcagagcugcuguugagucugaaauggaaguucuguugaaguugaggagugagguagaggaacagcugcagaacguacugagcaagaagguggaggugucguucgagaagaguaggauugagaaacuccaaaaggaaauugagagcgauaacucggcuguugugcaacuucaggcuugggcagaggaggaagccaaaaaggcccgggagcaugcacgcgcccuugaggaggcccg

SEQ ID NO: 4377 - RNA, 70 nt, Zea mays
ggcggcacauggcgucacagcgaagggugugucaaggcgaagcaacuucgugugaagcgcguggcuauca

SEQ ID NO: 4378 - RNA, 91 nt, Zea mays
uauuuccaguaauccagcuuguggcgagugacauaaugcuaauaagugacauaaauaaccauuugcugauaugcuguauauguuggucuug

SEQ ID NO: 4379 - RNA, 218 nt, Zea mays
uaauaacuccuagguacucuuugguucacauauuuguaauguaaugaauaacugauaacguuaaaccauguuuguuuaagcuaaacuguaaucagauaccacacuagaaauugauaccggucuauucaaacuuaauaucgcugguacucaagugugaaucauuaccguugccauuuacguaauauuucgugaaccaaacagcacccuaguugacacuu

SEQ ID NO: 4380 - RNA, 114 nt, Zea mays
augagcugguguuugguuguuuucaaugaggcucuacgcaugcgagcuaggcucccgccgaccuggcucauacagccgggcuaccggaagaagccaaccaaacaggcgguguag

SEQ ID NO: 4381 - RNA, 148 nt, Zea mays
cccgucgcacgacugccuguaccgcgccguggacaucuaccucaagacacacccggggcuggacgagaucgagcgggagaaggugugcagcgucauggacccgcucaggcugucguaccaggcgcggaugcacgcgucgcagaacaag

SEQ ID NO: 4382 - RNA, 61 nt, Zea mays
gaucucacauccucggcuccggaguucguagccgcgauccgugguuggggggaggcgaggu

SEQ ID NO: 4383 - RNA, 69 nt, Zea mays
agucgauguagggagaauguguuguucaagcugcugagugcaaaugauaauauugucccugugacauuu

SEQ ID NO: 4384 - RNA, 61 nt, Zea mays
cucgauuagucggucuggucaaaugaauaauugugauuagucgacuagucggucccauggg

SEQ ID NO: 4385 - RNA, 82 nt, Zea mays; identical to SEQ ID NO: 4333

SEQ ID NO: 4386 - RNA, 64 nt, Zea mays
caguuugaagacaugaaggauucugauccaguuauggaugaguucuaucguaguugugaauucc

SEQ ID NO: 4387 - RNA, 76 nt, Zea mays
gaaugaagccgccacugugacuguaugaagcaugcuuucauuuuguuucgucuucgucuucacgugccguuguaua

SEQ ID NO: 4388 - RNA, 137 nt, Zea mays
accauucuaagggcugauuuggaaaccacauuuucccaagagauuuuuguuuucccaggaaaauuaauuuauuuucccuugggcaaaauaggaauccauugggaaaaugguguucccaaacuagcccuaauaguagc

SEQ ID NO: 4389 - RNA, 151 nt, Zea mays
cagccauccgaggaagcggaggcccaccuccuuaccggacacaucaaagggagcgguucgcgcaccaagcucccgguaugcguccgcgagcugugcauguguccggucgaccuccacgcgaguagaggccuccgcuuuguccaggcagccg

SEQ ID NO: 4390 - RNA, 63 nt, Zea mays
cgcuuagggggccauuuggaggccgccgcugcgcgcguagaggcccccuacgcguauacagug

SEQ ID NO: 4391 - RNA, 224 nt, Zea mays
gccaccggcagcgccgccguggugaccaccaucguugcccgcgccgcgaucgccacgcccaaugcucuagggauggcugcgcugauggcgaggagcuagauggugcggugcaacuacgccaaggacgcggaccuagucaacaccagaggcgcaggcuccucgcucaucaacgaagcgcucgcggggaccgcgucgguggcgcccgagcuggcgcucguguacca

SEQ ID NO: 4392 - RNA, 83 nt, Zea mays
ucuggcuaguucgcgcaucgucguccuccuucuccucacagcccaggguugaagcagacggcugggggcgcgacggucgcaga

SEQ ID NO: 4393 - RNA, 175 nt, Zea mays
ugcuccuauggcggccgagcucucuggugccgcgggagugugccccuggcucucuccgaacucgccccagcgcugcugcucccuguucucugcacgcgccucuccuguaccagcgcgccgcuucaccugcucggccuccauggcgccgaggagcuuggccgccucaagcgauccu

SEQ ID NO: 4394 - RNA, 92 nt, Zea mays
gccgccgcgacgacgaggccaucgugccgugcgacuucaaccucaucacagacguggacuuccgggagcugguggaccgcgugccgcggggc

SEQ ID NO: 4395 - RNA, 111 nt, Zea mays
gucagcuggucccaggcaaggucuccgaggacgacaagcucaucgaguacgaugcgcugcucgucgaccgcuuccucaacauccuccaggaccuccacgggcccagccuuc

SEQ ID NO: 4396 - RNA, 152 nt, Zea mays
ccgcucgagaaccucgcugaccacauugccgaccccgucaacaacaacgcuugggccuacgccaccaacuucguccccggcaagugagggaggcgccgccggugaccuuuagguguccggaugcaugugagcgcacgcugguuuucgguuug

SEQ ID NO: 4397 - RNA, 72 nt, Zea mays
auugaacgggaacuaaguguagcagaaugaugugcuuuugcuagucaugcugcggcgccguuuuggugauuu

SEQ ID NO: 4398 - RNA, 251 nt, Zea mays
guggcaggcaccuugaccaugguguucuccuuguuggauauggugcuucugguuucgcccccauucgccugaaggacaagccuuacuggaucaucaagaacucguggggcgagaacuggggggagaacggauacuacaagauaugcagggguuccaacguucgcaacaagugcggcgucgauuccauggucucuaccguguccgcaguccacgccucgaaggaguagacucuggucagcggugauaaucgu

SEQ ID NO: 4399 - RNA, 103 nt, Zea mays
aguaauccuugcugucgucgucgucgucagucgucacacggauuauacgauucguccucauuguugcuguaugccguggcggcgccgcgaugaauccuggaag

SEQ ID NO: 4400 - RNA, 77 nt, Zea mays
gcaauauugccagaaguucuuauugaagcgccauaauaauucuccuacgucaauuugaacuugcucggucuauucaa

SEQ ID NO: 4401 - RNA, 210 nt, Zea mays
cagggcgcugucuggccggcggcguugcccgaccacccauuccacgagaagcacgacgcugucuggccagcggcguugcccgaccacccguuccacaagaagcaagauguugucugggcagucuggccggcagcguugcccgaccauccauuccacaagaagcaggacacuggcgggccuacggcagcauugccggaccacucauuccac

SEQ ID NO: 4402 - RNA, 190 nt, Zea mays
gugaauguuccuuuggacugaugacuuugccguagagguuagccgucacucgucacuggacagugcguuugcugcuauaucaagagguucuuuuuuuuaaaagcuugguuucaauguauacaaaguuucguuuaaggacccuuugcuacccccuuugcuaccgaguguaguccaaaggcuacuuaacuca

SEQ ID NO: 4403 - RNA, 156 nt, Zea mays
aggagaagcggcgguccagggacaagcugucgucgucggcggcgggggcgggggcgggaggcugugaggacgagcaccacgggacccgagcggugaggauagacgugaugccggccgaggacgucggcggcaugucgcuggagcgcagcggcagcc

SEQ ID NO: 4404 - RNA, 138 nt, Zea mays
guuaaucaaguaguaaaacaagcagcagcgaccgccucgacggacggacggacggaccgugucgucaggcgcggaagcagccaacgaagcgcggcaggugcaggugguggugcuggugcuggugcugcgcggcggcgg

SEQ ID NO: 4405 - RNA, 82 nt, Zea mays
uagcggaagaguuguacggugccaaggcugugccguccgaaaaagaaaauacagauauugugugaagugcauuaaacgcugg

SEQ ID NO: 4406 - RNA, 65 nt, Zea mays
gacaucuacgaccacgagagcuugguggcggcguuccaccagguugacguggucaucuccgccgu

SEQ ID NO: 4407 - RNA, 69 nt, Zea mays
uugcuuuagcgggagcugcugucgguauuggaaacguuuucaguucuuugauucauuccguggcgcgaa

SEQ ID NO: 4408 - RNA, 61 nt, Zea mays
gaaccagcaccagccuguggcgcaccggacaguguccggugcccaggcuggcccgggcggc

SEQ ID NO: 4409 - RNA, 90 nt, Zea mays
gagacaugcuuauuggauuaugacccagcuucgaauuauggcaauuggacauauggagcaggaguuggcaaugauccacgagaagaucga

SEQ ID NO: 4410 - RNA, 82 nt, Zea mays
gacaacacaacgguacucgauagaccaagugugccggucgaaagcccgacgcaacaagguaucgagagcgucguggaaguga

SEQ ID NO: 4411 - RNA, 145 nt, Zea mays
agaucauguauuuagggcuaguuugacaacccuauuuuucuaugggauuuuuaauuuccuaagggaaaacgaacuaauuuucuauaagaaaaugaaaaacccuuggaaaauugggguuaccaaaccagcccuuagugagugagau

SEQ ID NO: 4412 - RNA, 126 nt, Zea mays
gcucagcaagaucugugauggcauccucaagcuucuggacucccaccuuguccccucugccacugcagcagaguccaagguguucuaucugaaaaugaagggugacuaccacagguaccuugcgga

SEQ ID NO: 4413 - RNA, 87 nt, Zea mays
gaacgaacgccgugguugccgccaugauuucugcucggacuccgggcgccgccuggguauaaaucugcggccgcuaccaccucgcca

SEQ ID NO: 4414 - RNA, 76 nt, Zea mays
acaucgauuccggaggggagcggagugucaggucccgaucgccucccgaacacccgcugucgcuggcgucgaacaa

SEQ ID NO: 4415 - RNA, 84 nt, Zea mays
ccucucugggcuggaggaggucaaauuggaguugcaacucuacuuuguuguuuuuuaaauuagaccaccuccagaccagaaugg

SEQ ID NO: 4416 - RNA, 86 nt, Zea mays
agcgccgcagcgagcccaagaagccgaccgccgagcccccucuccaguccaguccgcggucucgguuucuugcuugcccggcgccc

SEQ ID NO: 4417 - RNA, 102 nt, Zea mays
cgcagggcauccgcugcgacuacaucggcuccgccaccaaccugguagguauauauauauguauacaugugaagucugaugaguacgugaggaaaagaccga

SEQ ID NO: 4418 - RNA, 622 nt, Zea mays
gcugaccaagaucugugauggcauccucaagcugcuugagacccaucuugugccgucuuccacugcccccgaguccaaggucuucuaucucaagaugaagggugauuacuacagauaccuugcugaguucaagacuggagcugagagaaaggacgccgcugagaacacgaugguggcauacaaggcugcccaggacauugcucuggcugagcuugcuccaacucacccuauuaggcuuggacuggcacuuaacuucucaguguucuacuaugagauucugaacucaccugaucgcgccugcagucuugcaaagcaggcuuuugacgaggccaucucggaacuggacacccugagcgaggaguccuacaaggacagcacuuugaucaugcagcuccuucgugauaacuugacccuauggaccucugacaucucggaggacccugcugaagagauuagggaggcgcccaagcgcgacucgagugaggggcaguaaagccggcuuuaugugccuagaaacuaguagcuaguguuugcugcugucgaaugacacuaugcaaugugaucuggaaccugguuucuugggugcgacgcuuguagccguguuaugacugucguccguaaa

SEQ ID NO: 4419 - RNA, 77 nt, Zea mays
aucaaagucuucgccacgcacaacgcccacgagcgcaucaccaagcucgagaacaugugcuggcggauauggcaccu

SEQ ID NO: 4420 - RNA, 356 nt, Zea mays
ucucugucugugagagaggcuggugcaaguuugcgucagcuaacugcugcuguacucagugcaagaaccgagcggcuugaugcgcgucacgcaugcacccaaacacgcgugcccguguccaagaaaugcgugugacgagcucgaggcuaucgucaucuggauguucucugguucgcauggaaacuguuccuccauggucacuagugugguggcuugugaauugugauguguagaaccagaaugaaucguauuuguggcgucauugcguuggauucggacgaguugaaaucggaagcuucucugugagagaggcuggugguacuggaccaggugcaaguuugcaucagcaagucucg

SEQ ID NO: 4421 - RNA, 148 nt, Zea mays
cgaagcggggagggccuguucgguuguuugggauuggagccccgaauuaauuccuagccgaauuacuuaucuaauuuauauagauuuuaauaagcuggaaugaauccuggcuuauuccgguacaaccgaacgggcccuuaguaaauua

SEQ ID NO: 4422 - RNA, 81 nt, Zea mays
gcuacugccggcgcaagggcgagcugcugcuggucuaugacuacaugcccaacggcagccucgacaggugccucuacgacu

SEQ ID NO: 4423 - RNA, 167 nt, Zea mays
ucguaggaacuuuuggcgcucaaguugacgugcaugacaccaagauguacaucuuuucuccugcaaccauugucgcuucgguuugaucaggaccgguggauccaagaugacagcaccgcuauuguucaaggauaugucacgacaacaagcgccuucgguuuuccugc

SEQ ID NO: 4424 - RNA, 169 nt, Zea mays
augguuccaaccgcaguugccacaugugcagcucuuggugaaggaggcucgccaagugggguaagccugcuccacuuguucaaugacacaucguagcaauggacaucugcuguggcaccagcaagaccugaccuggagucgugcgucggcgacggcgguggggacggag

SEQ ID NO: 4425 - RNA, 71 nt, Zea mays
cucugauuaaagaagacaaagcugcaaacagcaaucauucuguuguugcagcucaguccuugccaccagag

SEQ ID NO: 4426 - RNA, 88 nt, Zea mays
guacaaugaguggccauucuucagggucacccuugaucugcucgagaugguuuucgccaagggugacccgggaaucgcggcuguguau

SEQ ID NO: 4427 - RNA, 430 nt, Zea mays
ucucgagucccgaccucgacgcuaccggcucagcggcucuggugcuccguccuccacuccuccuccuccuucauccauuccuccggugcaagguccgucucugguguaccgcgccguccuguucggcggccucagcaacgacgucaucucggccggagcccuggggaucacgaccgcacagcuggugcgcaucaacgaccuccacagccggacggugcaccaggagaacgcccugucgaaccgacucgccacccugcaggaagacaucgccaaccgcccgcuccugcccaucgugcggcagcgcgagcucgccaccgcgacacgacugggagcugcugcgagcggaagcugcgacggcgcggcacgacgguggcuuagggcggcacggcuaggagaaccagagccgguauugucgaggcgguggacaacc

SEQ ID NO: 4428 - RNA, 102 nt, Zea mays
uauguuauuugcgcaacaucgaugacgcggauaaguuggugagugugaugaaaucauguccugguggaaaugcuguugucauuggugguggcuacauuggaa

SEQ ID NO: 4429 - RNA, 239 nt, Zea mays
gucuguaccaaccgcgagcuagccucacugacucaggucggcccgcuccuguccugccacugccaggacgccggcuacuggccgucgucgcgcuugugaaggaucuugcccgcgagcaccgccgacucgaugaccccacguaugacggacgccgucuggccgacgucgcacucguuccccgggaacgucggccccgccgggcucaccccgucgaggcagcucagcagguucucguugca

SEQ ID NO: 4430 - RNA, 78 nt, Zea mays
auucuucgccuguagcggugccgggacgccgugacgacaaagaccggacgccguggcgccaccuugcgugcuuggacc

SEQ ID NO: 4431 - RNA, 77 nt, Zea mays
ggcggcgcaggaacgagccgcucuaccuuguuccuagggccgucuagcuagcuagagcggcucguuccuuuuaagca

SEQ ID NO: 4432 - RNA, 64 nt, Zea mays; identical to SEQ ID NO: 4386

SEQ ID NO: 4433 - RNA, 177 nt, Zea mays
gagucagucagacagucagccgcgugccaugggccauggcauagcaugccuugcucuaucugcuccaucuucuucuacgcaugccuuguucuaguggugguacuggugggggaacgaauaauuguaccgagauguuggcgccgugucgugucgugucguguccuguccuguccuucc

SEQ ID NO: 4434 - RNA, 191 nt, Zea mays
acaaugggugccaccguaucuuggucaccggaggaaagucuuugggcaaugaggcuggcagccucguaugaugcuaacaagagaccacauauaaaccccucggauguucccaaaucuaggggaaggaauccacuuaaccgcccauauugggaggcuaacaggugauugguugauugguuggcuacgcuccg

SEQ ID NO: 4435 - RNA, 86 nt, Zea mays
gacgggaggaacagcguggguauauggagugucggauggggagggguggaccgcggacgugauguagcucacgcguggcucauuga

SEQ ID NO: 4436 - RNA, 454 nt, Zea mays
aaguugcgcaucggcggccacgggcggugucaugauacuuuuuguauuuguuuuuaucucaauaagguaacaguuuccaggcuacaggagucgaaacuaaaacauaacagcccuacuccuacccugaaaccugccuauacgaagaugaugccgugcuccuuaauggugucaaucacgaucccgagcuugcccucgauccucucguucuucuugggcucauaggccauagcaaagacgucggcguccauggaccucucggcgaugagccucccuaugguccggcaggcguugucgucgacaagagaugggagggugagccggagguccuuggaguuggugguggcgacggcaaugaccuugcuggugccccugugcaugaccuuugcgugcacgaagcgcuuggagaaaaaaacauugagcaggaaggggcgcauguacauguccgugcgcugcu

SEQ ID NO: 4437 - RNA, 79 nt, Zea mays
agcaauacuaugguauuauauacuuugagguguuuggcaacucaucugaaaucucuguauacuaaacuguaguauugua

SEQ ID NO: 4438 - RNA, 136 nt, Zea mays
auaaagcaauaaucuccgucggccagcguauaggccgacgaggaguuaacuaauucccgcggcuugcgucagggccgacgggaguuaacuaaugcccggcgguuuacgucagggccgacggaaguuaacuuaaggc

SEQ ID NO: 4439 - RNA, 248 nt, Zea mays
cagagugaggguaucacgucaucuucgucgugcaacggcucguuguggaugucggucucuagcgagcguugacgugcagcugccugugccuccuaugcagccggacguucagcgucccauuugugcaguuggaccaucuacagcuggacugagcuccucaugaucgacgcaggauacguuugaagacguggcccaugacgacgaggacgacgaugacgacgacgacgacgcuggcgcuggcgccgcag

SEQ ID NO: 4440 - RNA, 102 nt, Zea mays; identical to SEQ ID NO: 4428

SEQ ID NO: 4441 - RNA, 86 nt, Zea mays; identical to SEQ ID NO: 4416

SEQ ID NO: 4442 - RNA, 117 nt, Zea mays
caacggcaccggcggcggcgcgcgggcuccgagcacggcgccgcagccggcgucaccggcggcaucgcccccucccgccagcucgaccccgcccccgccgucgucgcccgcucccaa

SEQ ID NO: 4443 - RNA, 68 nt, Zea mays
gaucggauccuugcuagacucggcaucaucggacaguguucgaugugcaggcuggucagcggcugaac

SEQ ID NO: 4444 - RNA, 164 nt, Zea mays
cucccgcgcggcgcaaccgagcucgcggcggacggcgcccuccuccccgcgcagggccgcagcgccgccaccgacgacgcgcccagagucccgcucagcgccggagccaugggaugggagacagugaccgcucacaccacgagcuugcgcgccaacguucgugg

SEQ ID NO: 4445 - RNA, 126 nt, Zea mays
gccaacgaccgccucguccugccgagcgaugggccgacacucgaccgcaagcuaugggaagaccaagucguccuugggcgccaguguuccugcccauauuggauaggaucaagggcuugggccaug

SEQ ID NO: 4446 - RNA, 255 nt, Zea mays
gcuggagcggacggagccggaggugcgggccauguacgaccucuggcucgcggagcacggccgcgccuacaacgcgcugggcgagggcgagggcgagcgcgaccgccgcuuccucgucuucugggacaaccuccgcuucgucgacgcgcacaacgagcgcgccggcgcccgcggcuuccgccucgggaugaaccaguucgccgaccucaccaacgacgaguuccgcggccgcguaccucggcgccaugguccggc

SEQ ID NO: 4447 - RNA, 228 nt, Zea mays
ugaaaauaaggaggcgcagaucaguccaagcagccuuaacagccaauggauggguccaaacacucucuggaagccuuccggcacaggugcuguuugaguuuuuguuggucugggauuuacuccaagaggugcagcugcauccuaauguugaggaccaacaucgguggcugccaucuuccucggggcuguauucggccaguucugcuuauaugcgcuuccaugguggug

SEQ ID NO: 4448 - RNA, 71 nt, Zea mays
ccaagaagcaccauuuuuuccuuaggauuaacuuaaaagcaauccugacaggagaaacaggauucauggau

SEQ ID NO: 4449 - RNA, 70 nt, Zea mays
ggcguucugggagcugcucacguccggcgacggcgacgcccucccggagguguccaucuccccggacgac

SEQ ID NO: 4450 - RNA, 159 nt, Zea mays
gucgagaaggcggugcagaacuggauccgcgucgacggcgacaggcucagguuccccggcggcgggaccauguuccccaacggcgccgacgccuacaucgacgacaugccaagcucgucccgcuccacgacggcuccauccgcaccgcgcucgacaccg

SEQ ID NO: 4451 - RNA, 193 nt, Zea mays
ucacggucaccgucgcaaacaucgaggaaggcgggcaguucacgaucuccggcgcugaggagauccugaaggcgcuuuagaagcuccgucuccucuagaagccgcagcaacgaucggucuauaguuugaacucgccuuugaauaacuugucguugggcaaggucuaguucgguguuguguauggaacggucgu

SEQ ID NO: 4452 - RNA, 97 nt, Zea mays
gcguaucgaggagaaguacaccuggaagcuguacucggagaggcugaugacccucaccggcguguacggguucuggaaguacguguccaaccuggag

SEQ ID NO: 4453 - RNA, 65 nt, Zea mays
gcgcuagcgaggcuaauaccucggcguauggccuguggcgccgagcaguguuacuucagcgccuc

SEQ ID NO: 4454 - RNA, 67 nt, Zea mays
uuucuuuucgaucaaaggcuuuagcccaauuucauccgaaauagcuguugcccuuguuggaacugau

SEQ ID NO: 4455 - RNA, 162 nt, Zea mays
cagcggccgucgccacacuccugccucccuccacugccucugcagcgucuucuucguccaccugccucgacugcguccauuuuggcaagugcucagggugcacgcacgagguggaccucgacaagccgccggugcugcaggagguggcgaauuucuucaagg

SEQ ID NO: 4456 - RNA, 69 nt, Zea mays
ccgaaaaauaugaugcucauguuguugguauugaucuuuccauaaacaugguaucauuugcacuugagc

SEQ ID NO: 4457 - RNA, 72 nt, Zea mays
  misc_feature (32)..(33): n is a, c, g, or u
cucugauuaaagaagacaaagcugcaaacagnnaaucauucuguuguugcagcucaguccuugccaccagag

SEQ ID NO: 4458 - RNA, 288 nt, Zea mays
caagcacaaggucaccgcuguccccgccgacgaagaagagaucugcggugccacuuucaagguacugcucugcuuauuacaaaaacacaaacaagaagaccagcucaaccuagagacggaucuaucuaucuauauauauaucaugcaaucugugaucuguaacugcaggugguggaaggcucuacuguccugacggcgcugcacugaucggucaucagcuggcggaggcgaugcgaugaugaugcagaacuuuguacaugcguugguggauggugguguaacauagug

SEQ ID NO: 4459 - RNA, 226 nt, Zea mays
ucagcaucacccagggugcugcuguugccuuccucaagucgaucgucugcagauucagggucccaagucguaucauuacggacaacaggacccaguuuacaagucggcucuuccaggaguauugcgagggcaucggcacccagcucugcuuugcaucuguggcucaucccaagagcaacgaccaggcuaagagggcaaacgcagaaauccucaggggacucaagac

SEQ ID NO: 4460 - RNA, 163 nt, Zea mays
  misc_feature (155)..(156): n is a, c, g, or u
ugaucggagacagggacgaggcagagcauggguagggggccaucaacagaauucccaauuugauuucuguuugcucgcucacaaaauggagggacucacccacaacacacucaggcguugggugcucccuccccugcacuggccucuucccuggnnucuccac

SEQ ID NO: 4461 - RNA, 331 nt, Zea mays
guagccgccggugccaccuagugacgggaacgccguucggggccggauauggagcugaggagguagaguagaugaugggcgggugucgcuccagggaugaaucagagggugccgccaaccguggggauccuugccgguugcccuccucgcccaucaccacagagugcucuucaucggaucgcaagaacaggaggucgccaccgauggaacucggacuuguggcggcguguuuuccugagaagaacaggugguucaagaggagccacauaacgaggaguucgauuugaucuagguggcgucucccaguugacuuuauggcgccaaggaugga

SEQ ID NO: 4462 - RNA, 82 nt, Zea mays
uagcggaagaguuguacggugccaaggcugugucguccgaaaaagaaaauacagauauugugugaagugcauuaaacgcugg

SEQ ID NO: 4463 - RNA, 208 nt, Zea mays
agcucugggcagccucaccagcggcggcgaccaccuaugcgccgauggcuugccagcgacggcggccaccauagugcgugcgccauuacgaagagguccucauccccguccuccuauggggggcgacaacgaggccauuaaagccaaagaguuugaggcucgguggcagguggcgcugguggucuggccagcgguggcgaccaccucu

SEQ ID NO: 4464 - RNA, 184 nt, Zea mays
caagcacaaggucaccgcuguccccgccgacgaagaagagaucugcggugccacuuucaaggugguggaagggucuacuguccugacggcgcugcacugaucgaucaucagcugcuggcggaggcgaugcgaugaugaugcagaacuuuguacaugcguugguggauggugguguaacauagug

SEQ ID NO: 4465 - RNA, 71 nt, Zea mays
gcgaauuucgugguauuaauugggaccgucugauuucucauggauccauaguucuauucuacaagcauuug

SEQ ID NO: 4466 - RNA, 72 nt, Zea mays
ugauuacuaaccggauugcuucucuaauuuauauaaacuuugauuagcuggaacgauuccgguuacaauucg

SEQ ID NO: 4467 - RNA, 90 nt, Zea mays; identical to SEQ ID NO: 4409

SEQ ID NO: 4468 - RNA, 143 nt, Zea mays
auagagcgauaggagaacguguuggucugugguguagcuuuguuuuuauuuuguauuuuucugcuuugauguacaaccuguggccgcaugaacuggggcguggagaugggagcgaccaugccguacuuugucugucgcuggcg

SEQ ID NO: 4469 - RNA, 253 nt, Zea mays; identical to SEQ ID NO: 4371

SEQ ID NO: 4470 - RNA, 80 nt, Zea mays
ggagccgugagguaucgaucuggugcuccgguccggcuuugguuggauccgugagggaccgaucuggugcuccggcuuug

SEQ ID NO: 4471 - RNA, 189 nt, Zea mays
aaggaccgaugguuuaguucauagauguuugugguuuggugacuauuuaguuuaauaugucuguagucuuuugauguuuauaccuaccaaauguugacacaauuauauuacaaauagcaccuauuagggcuuuauggagauuauauuacaaaauaaugcgacaaauguucagagcuaaaaaaauaaaaa

SEQ ID NO: 4472 - RNA, 72 nt, Zea mays
gaggcagauaacccgggaaagaaguguuagagauugucguggugacgccuggccuaggguucaggcauagua

SEQ ID NO: 4473 - RNA, 67 nt, Zea mays
ccaauaaguaccauuuuuuccuuaggauuaacuuauaacaaauucugacaggaguaacaguauucau

SEQ ID NO: 4474 - RNA, 106 nt, Zea mays
ucauacaagaaggcaucaaguucagcauuggagacaccaccucuaggagugagaccacucauagaagucacaguacucuugcuugaaguugauguuguagguacug

SEQ ID NO: 4475 - RNA, 66 nt, Zea mays
gucgcggcgggcgcggugaccguggugggcgucgcggcggccgccguggcccgcgccaggaggaag

SEQ ID NO: 4476 - RNA, 74 nt, Zea mays
  misc_feature (12)..(12): n is a, c, g, or u
  misc_feature (25)..(25): n is a, c, g, or u
uuauuagaguanacgggguguuggnuucuguggacuaaaguuagcccgggucacauuaagcguuacuuuuaaua

SEQ ID NO: 4477 - RNA, 100 nt, Zea mays
guccgggagagcguguucuguggcauggcuuuggcaaggggcucgacacuagcgaaguagcgagcagggcccgaagcagagcagaacagcaggacacggc

SEQ ID NO: 4478 - RNA, 93 nt, Zea mays
ugagcccccauuguuggugagcucaugcacauuauuccccacacuuguugagcgaugaacuuuugugagcucacccuugcgauauauaaaccc

SEQ ID NO: 4479 - RNA, 111 nt, Zea mays
aucagcuggucccaggcaaggucuccgaggacgacaagcucaucgaguacgaugcgcugcucauugaucgcuuccucaacauccuccaggaccuccaugggcccagccuuc

SEQ ID NO: 4480 - RNA, 83 nt, Zea mays
cccagaucuucagcgagggcgggcuggacuaccuuggcaaccccaggcugauccacgcgcagagcauccucgccaucugggcc

SEQ ID NO: 4481 - RNA, 60 nt, Zea mays
cuaccagaagcagcgccgugggcccucgcggucuggggcucgggcugcugccagccucgc

SEQ ID NO: 4482 - RNA, 78 nt, Zea mays
uuucucuguuucuuuuuaguugucgcuggauaauuuaauuuuguacuauccaacgacaacuaaaaagaaacggaugga

SEQ ID NO: 4483 - RNA, 187 nt, Zea mays
acccaaacauggccugaucugguuggcuacgcuguuguagaugcgguuaauauuauccgucaagauaaucccaauauaaccgaaguucgaguacucccuccagauggggucccgucuccacuccaagauggugccauacguguuuguaucuacaacgacaucgucaauggucaggcuguugugguua

SEQ ID NO: 4484 - RNA, 73 nt, Zea mays
ucuacauguauugagguggauugagguguaaauuaguuuaacuuacacacuagucccccuuaaugcaugugaa

SEQ ID NO: 4485 - RNA, 264 nt, Zea mays
aggcccugcgcgccgcgucguccacgaacggguucacgcgcgggucguccagccccaccgugucggagaccacgaaccgccaggugcgguccaugaacggccggaucucggggccgaacgccgccaucucgccgcccacggccucgcugcccgugaaguaggggugcaccacggcgagcccgcggauggucacgccgucggggagcgcgccggcggcggaggcccgcacggccgugucgugcgcgauguuggcgccggcgcugc

SEQ ID NO: 4486 - RNA, 71 nt, Zea mays
gcugugccaucaguugcuugauacuggguucuuccacauugauccacaucuaggcaauaugaucagaacac

SEQ ID NO: 4487 - RNA, 141 nt, Zea mays
gccucgucggacggcucugccgcggcccugcccagcgcuaccgucgaugugcccggcgccggggccccuguccucgucgugggcgcgccggggcuccccgaggcugacuucaggaacgcgguggagucgucgcuguucaag

SEQ ID NO: 4488 - RNA, 149 nt, Zea mays
cugaguggauacaaugcaaagagacaugaguuugacccagaauacgauaaugaugccgaacaagcucuugcugagauggaauuuaaagaaacugauucggaaacugaucgugaacugaaacuccgugugcugcguauuuaccucuccag

SEQ ID NO: 4489 - RNA, 66 nt, Zea mays
cacgcacgccggccgcgaggucggagguguuccgcaacaugcuggccgccgccgcuggcgacgcca

SEQ ID NO: 4490 - RNA, 66 nt, Zea mays
gcugcacagagugcaguggauguguccgauggcacaucggauagacaugcguguacagauguguuc

SEQ ID NO: 4491 - RNA, 181 nt, Zea mays
ucgacacucugcugcugcgggccugcggcuggccgaccugaugagcgcagggagaugaggugcaagcuccacccuuacgccaacgccgugggcgucugcgcggccugccuccgcgaccgccuccucgcgcuggccgccgagcgcgcccaggccgccgccgaggccagcagcgacgggggcu

SEQ ID NO: 4492 - RNA, 191 nt, Zea mays
cucgccgccguguacgcgcugucggagccgcugcugcugcugcuggggcagucgccggagaucgccggcgccgccgccgaguucgccuacggccucgucccgcagaucuucgcguacgccgccaacuuccccauccagaaguuccugcaggcgcagagcaucguggcgcccagcgcuuacauccuggcggc

SEQ ID NO: 4493 - RNA, 394 nt, Zea mays
  misc_feature (269)..(269): n is a, c, g, or u
cgaaucuccggcaacccgugguacggccccgaacgcgugcucuaccugggcccgcuguccggcgcgcccccgagcuaacccuugacgggcgaguucccgggcgaacuccggcuuggaccccgcggggcugucggcggacccgaagacguucgccaagacccgggagccuggaaggucauccacuuccccgcugggccaugccugggcccguuggccugcguguucccggagccgcucgcccgcaaccgcgucaaguucggcaagcccungugguucaggcccggucgcagaucuucacgagggugggcuggacuaccucggcaacccgagccugauccacgcccagagcauccucgccaucugggccugccaaggucgugcucaugggcgccau

SEQ ID NO: 4494 - RNA, 122 nt, Zea mays
  misc_feature (6)..(6): n is a, c, g, or u
  misc_feature (71)..(71): n is a, c, g, or u
  misc_feature (102)..(102): n is a, c, g, or u
  misc_feature (121)..(121): n is a, c, g, or u
caucancacaaccaccaccaccgccuggccgucgucacacgcucgccugcuuccauggcgcccaggaacgnucuccccgccgccagcgccguggccaacggnauggugacggagccgaggnu

SEQ ID NO: 4495 - RNA, 288 nt, Zea mays
gcgggggcauuaaagguggugcggaugcuuucugauggcuuucugggccugggccgcuaugugccacuuggccggccugcccgucccaaguuggaaguggcuggcggggcuuaggcgaaagccugggucucucuaggccugaagcggcaggcauggcgugaggcuggcuucacagagcagcgaucacugcccgcuuccaacggugggaggauaacaggccggcugcacuucagagcccaacucgggcccagagccucauuaagcagaccaccaucuuuuuuuaauaaa

SEQ ID NO: 4496 - RNA, 112 nt, Zea mays
uucuuauguuaacggcugaucucgcuuguggccuuuugguuguuuguccuccuuaaacuucagaugcaagaaggucuuugcugguuauggagagaucaguugaaggguggag

SEQ ID NO: 4497 - RNA, 106 nt, Zea mays
ggggcagagcagaucgggcggacaccgcgccucaccucucucuccccuuuucuccugucccggagagaaaaacgagcgguggugucugcaggauuugcagggagga

SEQ ID NO: 4498 - RNA, 131 nt, Zea mays
gaaagacugaaccgaaacuaucgccauguucgcggauaccgugucgaguuuagucgugguacgcuagaugauuaugcgagcugaaggacauggaucagagcgaaccaugagaugguauuggaggauuaauc

SEQ ID NO: 4499 - RNA, 57 nt, Zea mays
uaagcccgggguucucgugggugcgauucauugcgccgccgcaggaucaucgugauc

SEQ ID NO: 4500 - RNA, 72 nt, Zea mays
cucuauuucuuuuuaguugucgcuagauaguucaaucuuacauuauccaacgacaacuaaaauaaaacggag

SEQ ID NO: 4501 - RNA, 66 nt, Zea mays
ccgcuggcggagcuggcgaagcgccuggcccagcgccacggcgucacguccacgcucaucacguuc

SEQ ID NO: 4502 - RNA, 146 nt, Zea mays
cucgacgauaugcgcaaccggcugcguguggucaugcugguguuuugcgcagcgcuugcgcgacgacaccgaucugcgcagcgccuacgaguugucgucgaaacccgcgcccuugucgacgucacgccuugcgcaucgcucgucgg

SEQ ID NO: 4503 - RNA, 132 nt, Zea mays; identical to SEQ ID NO: 4363

SEQ ID NO: 4504 - RNA, 69 nt, Zea mays
gaauagagccgagccgcuccguucauuguuuuguugaagagaauaugaguguggaguggaggagaggaa

SEQ ID NO: 4505 - RNA, 97 nt, Zea mays
caaaacuaaucacacagaugaggacuaaacgauaagacgaacuaauuaggcuuaauaaauuugccuugccguuuagucuucagcuguauaauuaguu

SEQ ID NO: 4506 - RNA, 78 nt, Zea mays
ccauugggcagcacgagcacgacacgauuagcgacgacccauuuagcccgcugauuggcccguucggcccagaaagcc

SEQ ID NO: 4507 - RNA, 74 nt, Zea mays
cgugcugugugggugcagcacgguagcaggcuagccaugugcccugcuguguugugucaccauccaucuauaau

SEQ ID NO: 4508 - RNA, 76 nt, Zea mays
gcgggacuucggcggggccuucgucuugucucgugugaacgaaggaggucgaacaggccuccguccgauuagcgcc

SEQ ID NO: 4509 - RNA, 290 nt, Zea mays
gaggcggcucgcucgugguggugucgcgcgagccaucgacgugcucgagguaucauugucacucguguuugacagagggguuaagagcuguguaagguaccuggacgcuguuccguggagcgaaucugaagaggagacaaucaagaggcugaugucucagcauccuucguacaaugcagcuuugagaaaccugcuggcggcgaggcugcagcccgccgagaggccugccucgucggcagaagcagaacuggucguugaacuggccgacuccaucacgaaggggaccaaca

SEQ ID NO: 4510 - RNA, 92 nt, Zea mays
cgucuagauggcguccaugggauccagguggcugcacacgugcaaguccaaugcgcggaggguguccgccuuaucuuauggggugucugguu

SEQ ID NO: 4511 - RNA, 212 nt, Zea mays
gcgacggcgaaucugaggcggcggcggcucaaucgggggcagcggcaacugaauggugggggagagaggcaaccuaggguugccagaggaaggauuauauggguuggcuggugggcugggccuccuaccccuuccuucuccuuuuuuucuuuuucuuuuuucuuuuucuuccuccuccauggggcuguuuugcugauucucagguugauaag

SEQ ID NO: 4512 - RNA, 88 nt, Zea mays
aaguggaggguguguaccuacacguacgugguggcugugcauacaugacggaacuacgcuaccguacuuguugugccacugcugcagu

SEQ ID NO: 4513 - RNA, 249 nt, Zea mays
uacugguaacuucugcacccagugugaagcagaaggguuucggaagauuaccuacuuucaggaccgcccagauguuauggcaaaauauacuugccguaguauccgguuuuauuguccaaugggaaucuuauugagcagggagaccuugaggguggaaagcauuacgcacugugggaggaucccuucaagaaaccaagcuaccuguuugcucuaguugcuggucagcugggaugccgggaggauucauuu

SEQ ID NO: 4514 - RNA, 251 nt, Zea mays; identical to SEQ ID NO: 4398

SEQ ID NO: 4515 - RNA, 63 nt, Zea mays
acgacaaguucggcaaggacuacuuucugugcacggggauggcguccauguuggugcccgucg

SEQ ID NO: 4516 - RNA, 81 nt, Zea mays
cgacgccuuacccucgucucuggacuccgucgcuaccgaggugucgaagauggagauccaguggucgcgggaggcacgcgc

SEQ ID NO: 4517 - RNA, 87 nt, Zea mays
aaguggaucacgggggaucgaagggaauugagggggaaaugaacuaauuuuccccucaauccucuccgauccucccgugaucccugg

SEQ ID NO: 4518 - RNA, 141 nt, Zea mays
gauggcgugggcgcguggccggcuggguucgguggcggccgaccgcgugguggugacucggcgccccaggagccgggauggcgggauaucccugcaggcugcacugcgaugcgagcccuggcggcuggagccuggagcuag

SEQ ID NO: 4519 - RNA, 184 nt, Zea mays
guaucuagcugcaaucgacaaguucgacgccauguugucgaggagcaacacuuaugcuccagaagcucucuacagauggggcacugcguugcagcagcgcucccaucugcggccucggagcaacggugagaagauaaggcuucuggagcaggcgaagagcuuguucgaagaugugcuguaugug

SEQ ID NO: 4520 - RNA, 59 nt, Zea mays
gcccuucacgacgacgacgacgacggcgacaccgucgucguccucguccacgcccgucg

SEQ ID NO: 4521 - RNA, 98 nt, Zea mays
aguugggccgcuuaggccggccagccaggcugggccggcgugcuggucaccaggccgcugccuggcccgccuggcaggccgccugggcugcuucugag

SEQ ID NO: 4522 - RNA, 172 nt, Zea mays
ccacaggucguugcccauggugauccggccgccaccucccgcaucgucgcggccaagacgccguuucuuggccagggucgcgccgccgccgccgccgccaaugccagcccccuccgcgacgucgccgccgccgaugcugauggucggauaauacuggaauaaggacugugug

SEQ ID NO: 4523 - RNA, 167 nt, Zea mays
ucugagaugaugaugaugccugauggcggggucguguccuguacugcuccccugcccucucgggcgcuucugucggggagcagagcguuguguuguguugugugggugcagcacgguaccaggcuagccaugugcccugcuguguugugucaccauccaucuauaau

SEQ ID NO: 4524 - RNA, 71 nt, Zea mays
aaaaucgaucagcugcgccacggcgagccucucgcgggcgacgcacgccgaagcgcaggcuggcgccgcug

SEQ ID NO: 4525 - RNA, 170 nt, Zea mays
ccugcaccuuugucgggacagucagcuaagagagccuuacaauuuauggggacaaugcaucaguauccucuccauauuuugguagauucuggcaguacccauucuuuucugagccagcacaugguggacaaaauagguucucuucaguuggugccuaccaauguucaggu

SEQ ID NO: 4526 - RNA, 105 nt, Zea mays
  misc_feature (96)..(96): n is a, c, g, or u
ugcuuuuguuacgucucuuugauuuucuagcaaucaucucuucgaggucacgcaacagucugcuugaugaugaauacuaaauauugauugacgugngaaaaaaaa

SEQ ID NO: 4527 - RNA, 200 nt, Zea mays
gaagcgccaugucugcgccuggcucugagcuagagaaugcugcagcagccaugaccaauggccacgagucaucgaguagugguguuuaauccagcgaugggguaaaagccacgaggagcaucaucccggagugaucucugcaguaggcggucagcugcuguacuauaauugaguuggaggcugcuuagauauggaauccu

SEQ ID NO: 4528 - RNA, 67 nt, Zea mays
agggugggcaggaagaggucgucgucgcagggcauccgcugcgacuacaucggcuccgccaccaacc

SEQ ID NO: 4529 - RNA, 189 nt, Zea mays
cgaggaaggugcaguguuaucguuuggucgucucucugcugcuuuggucaacggcggcuuggcgcccgccggagggggcuacauugccuccggcgugucugcgcuugauacgugcaggcaaccaaacacaaacucagauaaagucaacgcacauagugacgcgggacgagacggugcagcuaaccaauc

SEQ ID NO: 4530 - RNA, 131 nt, Zea mays
acagagucaucaagccuggcgauugcgugcuaaugagggcaucugaugcuucaaagccaccuuauguggcaagaguugaggcaauugaagcagcaggaucucgaggcaccaaugugagaguacgagugcgg

SEQ ID NO: 4531 - RNA, 66 nt, Zea mays
caggucccggcuggacgccgccacggccguggacgagcgggccgaggcggugcuggccgagcuguc

SEQ ID NO: 4532 - RNA, 145 nt, Zea mays
cuauguauauguguguacagcgaacggcaugugcugcugcuacuacuacuguaaaaggcugcuuacugugcuugcguucucucuucugcaacccaaauugaguguaaagaugcaugugcugcuugcuguacacacauauacauag

SEQ ID NO: 4533 - RNA, 94 nt, Zea mays
cguucccguccccgucuccgagccgugagcgcccgccacgccgucgccgagcccgagcccaagcgccaccgucuccgagcugggcgcccgccac

SEQ ID NO: 4534 - RNA, 232 nt, Zea mays
uuccauaagauuuaucacacggcuuaacuauaacauaugcgagacaaauuccaaagaaaguuauauauauauaguagauuuccuuaauuuauuuauccuacaaaacacaucuuugugucuggacaguaaccauauuugggaggauaaauaaauuaaacaaaccagcuacauaccuucuuuuaaaauuucucuagccaaguuguaguugaagccugugaugaaucuuaaaaaa

SEQ ID NO: 4535 - RNA, 67 nt, Zea mays; identical to SEQ ID NO: 4454

SEQ ID NO: 4536 - RNA, 88 nt, Zea mays
uaaauaaucaaauuacucucgauuuguuauaguacauggggaaugaaaacguaauauagacauaauugguguaguaguguagugguau

SEQ ID NO: 4537 - RNA, 84 nt, Zea mays
cagaacucgccgcaggacuacguggacccgcacaacgcggcgcgcgccgacgugggcgucggcccgggggccugggacgacagc

SEQ ID NO: 4538 - RNA, 77 nt, Zea mays
ugcgggggcucgggacgggaacgggacaggaccccaaaaucucagauccuuccugcccgcccgcccgugcccgucga

SEQ ID NO: 4539 - RNA, 169 nt, Zea mays
cucgccauccuccucgccgucgcccucgccuccgcuuccucggcaccccagcccccgccgugcagccgcucgugcgcggcccucaacugcgacuccgucgggauccgcuacggcaaguacugcggcgugggcuggagcggcugcgacggcgaggagcccugcgacgacc

SEQ ID NO: 4540 - RNA, 72 nt, Zea mays
cacagucaguugguugaauggaagcagcuguugcaaguaggcagcaggguuugccacagcuagcugagucag

SEQ ID NO: 4541 - RNA, 77 nt, Zea mays; identical to SEQ ID NO: 4538

SEQ ID NO: 4542 - RNA, 70 nt, Zea mays
ggugcggugggcgauggaggugggcgugugggccgugugccucggcguuggccuccucgccacggccagg

SEQ ID NO: 4543 - RNA, 194 nt, Zea mays
gauuagauuaguguaugguugucgacacauuugucuaucauuacaaaauucuaaauugacucuuuaaaauaaugucucguauugauaauguuuaacacacggauuuacauaucauagugauauuugucguuccguuuauauauuucauaaaauauuaaaccucugucgcaacgcaugggcacucaccuaguagu

SEQ ID NO: 4544 - RNA, 147 nt, Zea mays
aaacuagaauaaaguuuuaguuucuauauuuagcaauuuugcaacuaaaauggaauaaauuguagagacuaauguuuagucccuccauuuuauuccauuuuagucccuaaauuacuaaauauagaaacuaaaacucuauuuuaguuu

SEQ ID NO: 4545 - RNA, 155 nt, Zea mays
gcgggugcagcgaaggcgucguggaugguggccaugagcgugggcgccguggaggcgcucaaggaccaggguggccucugccgcuggaacuacgcgcugcgguccguccaccgcaccgccaaggccaacguccgcagcagccucgccgcgcagcg

SEQ ID NO: 4546 - RNA, 271 nt, Zea mays
cguacuuccuggcaucaagguugacaagggcaccauugauguugcuggcacugauaaggggaccaccacccaaggccaugacgaccuuggcaagcgcugcgccaaguacuacgaggcaggugcccgcuuugccaaguggcgcgcuguucucaagauuggcccuaaugagccaucacagcuugccauagaccugaacgcucacggucuagcucgcuacgccaucaucugccaagagaauggucuggugccaauuguugagccugagauccuu

SEQ ID NO: 4547 - RNA, 77 nt, Zea mays; identical to SEQ ID NO: 4538

SEQ ID NO: 4548 - RNA, 108 nt, Zea mays
uauagcggcgucgcuguguguguuucgagucagucagucaguuaguugcgugccauggcaugcucugagucugagaugaugaugaugccugauggcggcgucgugucc

SEQ ID NO: 4549 - RNA, 112 nt, Zea mays
uauagcggcgucgcuguguguguuucgagucagucagucaguuaguugcgugccauggcuggcaugcucugagucugagaugaugaugaugccugauggcggcgucgugucc

SEQ ID NO: 4550 - RNA, 76 nt, Zea mays
aaaauauuguuuuacaucguauauuauuuauauaguaaaguuuggauaagaagugugauggggaaggauaagaaag

SEQ ID NO: 4551 - RNA, 183 nt, Zea mays
gaucugcugcacggcguaggagauguccggccuagugaaggugagguacugaagagcaccggcaagacucuuguacccggugggguccucaagaggcggcccaccgucgacggugccccggagguggcggaggagggguuugagggccgcaggguggggcucucaggggucgugcauaugaag

SEQ ID NO: 4552 - RNA, 132 nt, Zea mays
uccuccuccccgccuccaggcugguuggcuagcugcaaccacucgcgagcuagagcuagcuaacuggccagcagcuccaggucgaacgaagcuuagcuagcuagcucaccggcaggagcggagcuaccccuc

SEQ ID NO: 4553 - RNA, 73 nt, Zea mays
cgaggaccuccaggcacagcaggucccauucagaggauauuugagugacauguuggcucuggugaaaaaggaa

SEQ ID NO: 4554 - RNA, 72 nt, Zea mays
ccacgugugccgcaccguguucaacaccgaccuccgcggcgugcugggcauggugcggucccccugcguggu

SEQ ID NO: 4555 - RNA, 213 nt, Zea mays
agguucuugaugugcugcucaagagcauugaugucuuugccagauggguccuuggccacgaagcagucgucaucgauggugaagacguacuucuuccuuggagaccauguagccgaagcaggcggcacgcggaguccuugaaggagaugcaugaggccuuggggccgagaaugcgguugaugucguugcgguuguagagcucguagucgaagc

SEQ ID NO: 4556 - RNA, 159 nt, Zea mays
auguauggucgacggucguugcuggcuuggcuuccggaguccgaacgcagcaggcauacuggugcuggaagacgguaccugcugucgcacuugccguuauaauaggcauuggaacuugucgauuucgggagcugaucuguuuguaccguauuguuuaua

SEQ ID NO: 4557 - RNA, 188 nt, Zea mays
gguacaccggcucguacuggaggaggucagcgucucgcucaguuugcaccacaagggacuccacagacucgucaggcugccccuacuggcaccccagcgagcacacuccaggaucuggcaagggauucagcauugccaggguuaaucaaguuagugcugaugcuaccgcugauggagcugacaucgua

SEQ ID NO: 4558 - RNA, 109 nt, Zea mays
auggcugaagaggauguccagccccuugugugugaaaauggcaccgaaauggucaaggcggguuucgcuggugacgacacaccgagagcuguauuuccuagcauuuauu

SEQ ID NO: 4559 - RNA, 262 nt, Zea mays
gacuccgagggccucgccgagagccugcgcgcgcugugcgcgcggauggacuccgccgcguuccugggcuucgugguggcccgccgcaaggaggcggacgcgcugcgggccgagaugccgccggcgcucaagcucugcguggauccggccaaguucgucauggacgccgucgccgacgucuuccccgucgaccgccgcgagguccggaaccccgccgaccuggccugggccugcgugcucauccucgaggccgccgugcccg

SEQ ID NO: 4560 - RNA, 236 nt, Zea mays
cuccgcaagcggaagcgcgaggaacagugggccaccgagaagaaggagaaggcccuagucgagaagaagaaguccaucgagagccgcaagcucaucuucacccgcgcaaagcaguacgccgaggaauacgaugcccaggagaaggaacuggugcagcuuaagcgcgaggcccguuugaagggugguuucuaugucaguccugaggcaaagcugcucuuugugguccgcauccgggg

SEQ ID NO: 4561 - RNA, 157 nt, Zea mays
ucaacgaggcccagucccgcggcggccguggaggcggcggcggcggcuacugugguggccguggaggcggcggcuacugcgguggcgggcgccgugauggcggcggcggcuacugcgguggcggcggcggcuaccguggcggcgguggcuacugugg

SEQ ID NO: 4562 - RNA, 101 nt, Zea mays
ccuacgccauauggauuggacgggauuggaaaauuuuaguagacauuuugacuuacuauggauuuaaacccacccaauccccuccaauccacauggauuga

SEQ ID NO: 4563 - RNA, 258 nt, Zea mays
aagaugugauugcauagauguaccuucugacaugcgaauaggggaaagacgcuccuuaagacguaacuuguuuguaagacucuuggucauauacagcuccuccaauuucuuccauaauauugcugcggauuuuucaugcauuacuucacgcagaacaucaaaagauaaacugaguuguauggcggacaaagcucucucaucaauaucuugccacuuaucaucagucaugucagcagguugcgucugcaacgccuuuug

SEQ ID NO: 4564 - RNA, 237 nt, Zea mays
ggugggcgcgaggaccacagcgccguugcggacgguggcgcugaagccgucgucugccuugcagaagaugcgcacggugggcucugaggagccgccgcggggggcguuggcgcugccuccggcguaggccucuucgccccaggggaggaucuuccagcucugguugucgcccuuggcccacucccagaggacgacgguggugccgucgugcacgccgccgugguccuugucgccguu

SEQ ID NO: 4565 - RNA, 159 nt, Zea mays
cagccuccgccgcccuggauuuggccuccgccgcucccgauucggcgcugccacccugaaacagcgccgccccuuucccuuccccuaugcccuaugcccucuugcugcuucucaccuaggcgacggggacgccuuggauccuucgggcgccuggacgcc

SEQ ID NO: 4566 - RNA, 413 nt, Zea mays
gaccaccccgucugcuguccgcucugugaccaggccgaugagaccauuaaucauuuguuggucaagugcagcuuugcaaaucaguuuugguuucuucuccuucggucgggggacuuccaggugcucuguccaucuacaggggauagcuacuuugacuccuggugggagaagagugcugaguugaucuccugcauauucaagaaaaaaaauaagagagcaaagaucaagcccaagaaaauuauugauguucucuugucuagugauacaacuaaagcucaagguuuccuccaagagaauggagaugauugugcauuaguuuccuuuagagaugacgaagaugaggaagaagucauggaggugcagggauaccuuggucuaugcuuggagaugcggugggagcagaagaacaacua

SEQ ID NO: 4567 - RNA, 206 nt, Zea mays
cccccggcgaaaacugaugcuggccuggacuggaaaagugcacugggagagaaccccagaugauuaaccaagcccaagucuggucauaaacgcuucccuuucaacaauuucacguacuuuuuaacucucuuuucaaagugcuuuucaucuuucgaucacucuacuugugcgcuaucggucucuggccgguauuuagcuuuagaaga

SEQ ID NO: 4568 - RNA, 72 nt, Zea mays; identical to SEQ ID NO: 4540

SEQ ID NO: 4569 - RNA, 122 nt, Zea mays
uucccuacugguucucugccaugaccaugaagaguguuggaagcgccgcccugaagaugguggaggagguccgcaggcaguucaacaccauuccuggguugauggagggaacagccaagccc

SEQ ID NO: 4570 - RNA, 142 nt, Zea mays
accaaggaggacgucgcgugguacugcgggaagcggauggccuacaucuacaaggccaagaccaagagcagcggcacccacuaccgcugcaucugggggcaaggucgcccgcccgcauggcaacuccggcgucguccgcgcc

SEQ ID NO: 4571 - RNA, 69 nt, Zea mays
ugcgggggauggaggcgcuuugccaugguugcguucgagcuccuggcuagcccacccacuagcuuuccu

SEQ ID NO: 4572 - RNA, 210 nt, Zea mays
cggggccgcucgaccgccuucgugccgugcgcgccuccccaccucuuccguucuccgcuccccgcgcccgcgaaggcgaauugcugaauugagggugguggcucgugcuugauuuugauuuugggggucgguuucaguuccaauucaugacggugcggccgggguggguggugaggguggcgcauggcucggcggcggcguggcagcgcg

SEQ ID NO: 4573 - RNA, 68 nt, Zea mays
gcaacaauugcugccauacaaccaguucucuuugaugaacccugccuuguuguggcagcaacccaucg

SEQ ID NO: 4574 - RNA, 63 nt, Zea mays
cguggguggaggcuggagcgggggcacggugaggucgguggacgcccucgcucgagccucaag

SEQ ID NO: 4575 - RNA, 90 nt, Zea mays
cuagcaaaggggcccacuggugcucccuugccgagugcuacuccagcagucacucggcaaaagggacuggcaaagggacccaccggaguc

SEQ ID NO: 4576 - RNA, 112 nt, Zea mays
  misc_feature (59)..(59): n is a, c, g, or u
  misc_feature (79)..(79): n is a, c, g, or u
uauagcggcgucgcuguguguguuucgagucagucagucaguuaguugcgugccauggnuggaaugcucugagucuganaugaugaugaugccugaugguggcgucgugacc

SEQ ID NO: 4577 - RNA, 207 nt, Zea mays
gggcgacgagaguuuguagccaauggucugaugugguucgugggcuuuguguaggugcacaguuucacguauauguucuggucguguaaucuauauguuuauauaaaccuguagggguguugaugaccaucgaaagugucguaaauauucaguaguauauguagcuuagggcuuaagcgguuguguuuauaaggucauugucguugu

SEQ ID NO: 4578 - RNA, 70 nt, Zea mays
cggaucuccucgguccgcguucaggauaugcagcaacuuggguauuuuggcaguggaguggggcguguuc

SEQ ID NO: 4579 - RNA, 89 nt, Zea mays
gcaaugaugggguaugaccagggggggccuggaaacagggcaccuccugccccugcugugccuccccacuucaugccuaacuuugcugu

SEQ ID NO: 4580 - RNA, 68 nt, Zea mays
accacgcucuggaccugcaccgaugucacgcaccucgugcacgugcuccugcaguuccgccucgucug

SEQ ID NO: 4581 - RNA, 66 nt, Zea mays
gugcggugggugaagcgcgggugcuggugcgggaagccucgccagaccuagcgcugccgacugccg

SEQ ID NO: 4582 - RNA, 74 nt, Zea mays
gguaacagcauccaucgauccacaguccaugcugguugaugcaugggucugcuggaccccaggaugaacccagc

SEQ ID NO: 4583 - RNA, 211 nt, Zea mays
guucaucaaagagaacugguuguauggcagcaauuguugcugcuguaggaaggcagcgaccaaugggcagcaggguuugccacaacuagcugagucagagcugguacaaucuguugcagcaacuguuguugcaacaauuguuguugcagcgcuggcagaaacuguugcaacuguuguuguugcugguuugcaacuacguuugccagagcaa

SEQ ID NO: 4584 - RNA, 150 nt, Zea mays
cagcagcagcgagcgucgucgucccugcugaucaccaugaacguucgagggaaagcgaagcugacaccgccccucccgcgcggguucuacggcaacggcuucguguucguggaggcggagcugcgcggggcgacgcgcucgcucgguggc

SEQ ID NO: 4585 - RNA, 177 nt, Zea mays
  misc_feature (35)..(35): n is a, c, g, or u
acgacggcgggacgacgacgacgaugguggcugangccccgggugugcaugggcaagagccagcaccacucguuccccugcaucuccgaccgccuuugcagcaaccagugcguaaaggaggacggcgguugaaccgccgguuacugccaccuucguuacugcaggucccaaaaggcg

SEQ ID NO: 4586 - RNA, 76 nt, Zea mays
aggcaucaaugcagcccgacggcgacgcccuacuggcucgccccaguggcagucguugcgggcagcaguggugcca

SEQ ID NO: 4587 - RNA, 118 nt, Zea mays
gagcucuucgcggacggccgcauccgcgcguccuacccgguguucggccgaguccuagacgaggccgcggcgccggcgccgagggcgccgcuggggcggcuguuccagcuggagcggg

SEQ ID NO: 4588 - RNA, 146 nt, Zea mays
agcggcuuacguggcagguugggcuucagauggacgaugaguuggaugacgugauggcgucgucaucgaaugcggugccuagaacaaccugagagucgccgacguuggcgacgaccaugagguccaccugcuucacgauggacagc

SEQ ID NO: 4589 - RNA, 74 nt, Zea mays
gguacaggcaucgucccacggcuuuuucuugagggcagagguaaagaagaaggcgucgaggcgaaucuccagga

SEQ ID NO: 4590 - RNA, 239 nt, Zea mays
ccgucguugucggugcugaugcgguugccucugcuggugagccacucgggguuuguuauccuguggcccuucugguguggagguccacggcacaggaccuggcugagcggcuacauggcuuccggaccccccaggagacaagugucuguucuucaaagccggaccuccagggcgguggagcgugcaggcccacgauacgggaccaggcugagcggcugcaugggcuccggaccacccca

SEQ ID NO: 4591 - RNA, 117 nt, Zea mays
gagcuaguuugggaacaccaauuuaucaagagauuucuauuuucccaugggaaaaugaacuaauuucccuugggaaaaugaaaaucccuuggaaaauugggguucccaaacuagccc

SEQ ID NO: 4592 - RNA, 67 nt, Zea mays
cgcgccggcgucccuggaggaggccucggaccggcgccugauggcgcucauccuggacgccaagggc

SEQ ID NO: 4593 - RNA, 71 nt, Zea mays
gcaguaccgcaucggacagaguaguuguugggucucgacucccgcaacugcucccgcuccggcgaaggcga

SEQ ID NO: 4594 - RNA, 108 nt, Zea mays
uauagcggcgucgcuguguguguuucgagucagucagucaguuaguugcgugccaugccaugcucugagucugacaugaagaugaugccugauggcggcgucgggucc

SEQ ID NO: 4595 - RNA, 99 nt, Zea mays
uacaagaagcuggagugguugucugaaggcuuuugaacugcuugaagcauuaguguagcuuuggugcuuuugugacugaucagcucuggagcagcuaga

SEQ ID NO: 4596 - RNA, 68 nt, Zea mays
ucaacaauugcugccauacaaccaguucucuuugaugaacccugucuugucgaggcagcaacccaucg

SEQ ID NO: 4597 - RNA, 99 nt, Zea mays
gacaggaucgcgcgcgacccgcagcuggcgcggcugcugcagagcagcccgcagcgcaaagugcuguucaccaacucggaccgcgcgcacauggagcgg

SEQ ID NO: 4598 - RNA, 75 nt, Zea mays
cauacucuccgcaggacaguuuugacguugagguaaaugaucuacuaucuacguugaagguuuugaaguuaaguu

SEQ ID NO: 4599 - RNA, 189 nt, Zea mays
ugcaggugcagggcuccucgccgucgcagccgcuccaucccacaccgcaguacuuaccguagcggaucccaacggcugcaguacuuaccguagcggaucccgacggaaucgaugaggauggcuggggggggucgcaauugagggccgcgcaagagcggcugcggcgggggcuggggccuggggcgccga

SEQ ID NO: 4600 - RNA, 136 nt, Zea mays
aacggcgacaaggaccacggcggcgugcacgacggcaccaccgucgugcucugggaguggugcaagggggacaaccagugcuggaagaucuggccgugggccgaggcgcacgccgccgucgaguccggcgccacca

SEQ ID NO: 4601 - RNA, 74 nt, Zea mays
gcuguguucauccucggcuccagcagacccaugcaucaaccagcauggacuguggaucgauggaugcuguuacu

SEQ ID NO: 4602 - RNA, 270 nt, Zea mays
cgcgugggcugccgcuggagaaggccggggagcuggaugcugaggaguucuacacugagauauucagugguggccaauucaugcagcaagggauguguaauggccuuccagauguugauucgguguucuacuucacucggaagucauuggagauggaggcauuugauuuccaguuugacgcggaugcacccaaggucgcgcugccgcagggcaugaugacaccagucaacucuguuaacacauuguuccacucgccggcguucugggggc

SEQ ID NO: 4603 - RNA, 91 nt, Zea mays
ucggcggccacgguagcggcggccucgacgucacggcgcugcaccuugacgcagcgcaggcgcuuccgguugccccacuguaacaccaggu

SEQ ID NO: 4604 - RNA, 77 nt, Zea mays; identical to SEQ ID NO: 4538

SEQ ID NO: 4605 - RNA, 80 nt, Zea mays
  misc_feature (73)..(73): n is a, c, g, or u
  misc_feature (79)..(79): n is a, c, g, or u
agauucuuuuaggccucguucguuuucagccgaucagcccauuccuguuccggguggaacgaauggaccuggnuugcanu

SEQ ID NO: 4606 - RNA, 159 nt, Zea mays; identical to SEQ ID NO: 4565

SEQ ID NO: 4607 - RNA, 106 nt, Zea mays
ccguagugcucggcuucuucgucuucgucgucauugggucaucguuguuccagaucaucaggaccgcgaccaguggcggcauggcuugagaacccguccccggugc

SEQ ID NO: 4608 - RNA, 232 nt, Zea mays
aagcauagcauaguaugcguguuagcuagggugaucaaucuugauccacucaaucaauguaguagauggacguuacagccaucaaauguugaacauauauaaugcaaaguuuugauuugauuggguguacaaguauagccuaguaaguaugagugagucuggcugcucagaguuaggcuaaacuuaugcaaaagaucuuucuuuaguuacucguauccaguuauacaugucg

SEQ ID NO: 4609 - RNA, 253 nt, Zea mays
acugcggccgggcgauggcgagcguggagggcaagagggagacggugcuggucaccggcgccagcggcuucaucggaucgacccucgucggccuccuccucgaccgcggcuacaacguccacgccagcguccucaaccccgaugacaaggcggagacggagcaccuggucgcccugggcgccggcgccggcgagggccggcugcgagucuucccgggcgaccuccucgacggcgccgcgcucauggccgccgc

SEQ ID NO: 4610 - RNA, 80 nt, Zea mays
ugaccagcaggcuuggaccgccugacuucaccgcagggaagacccgccucugcgcgaggucgcggacuguccgguccuag

SEQ ID NO: 4611 - RNA, 210 nt, Zea mays
auucauaaaguuguccgcaacaaaucguguaaaauaggagauuugcacgguagauuacauuguuugcagagugaaguuugaaauaugggaugagcuaccuuaucucaucccuugucucaucacuaucucaaacuucacucuacaaacaguauaaucuacaguguaaauccccuauuuuacacgaucugccgcggacagccuuaugaggca

SEQ ID NO: 4612 - RNA, 148 nt, Zea mays
uagagauuaugggcauguuugguuuguggcuaacuauaccacacuuugucuaagauuagucguucgaauugaagaacuaaccuuaaccagaaaaguuagguaaaguguggcaaguuagacagcgaaacaaauagguccuauauugaua

SEQ ID NO: 4613 - RNA, 183 nt, Zea mays
uugagacuucaagacaugccuugggcaucaaguguuuauagcauacuucuacuucuaauccgggacucaaacaauuauaagauaaagaugcaugcagcuguugcucuaucagugccagugucaaggcuugauuacgacagcucauuuccagauguuguucgaggccucgugcaugcucucgag

SEQ ID NO: 4614 - RNA, 80 nt, Zea mays
augcacucuggcuggccuagacugccccugauccaugguggccaugucuucgguacgucuugucgagcucuugcaugucg

SEQ ID NO: 4615 - RNA, 78 nt, Zea mays
aauuuguguuguuuguuugucuuuuaacuuauuuaagcuggauuauauaaucuagaggguaaacaaacagggcaaguu

SEQ ID NO: 4616 - RNA, 128 nt, Zea mays
caggcucugccgggcggugauugaguacauccugacgugcuuucggagccacgacccgaccaucuccuuggagccggugauugcugguccgguggucgacacugaagacgccgcccgggaggccguac

SEQ ID NO: 4617 - RNA, 93 nt, Zea mays
guccaaaggugacacucgacaaagcguacugugccgagugucagccuagguaacacucgguaaaguuuguuuugccgagugucuuacgggaac

SEQ ID NO: 4618 - RNA, 433 nt, Zea mays
aggaucggucuacuccugggaagaucucugcgcgcgguucacagugaacuucgccagcgcuuaucaacagcauggcguggaggcucaacuccaugcaggggugcaugaugaaaagaugcuagagaaguuggccacgcaugacguggaaacugucaccacacucuucgcucugggcgacaaguacgcuaggguugcugagggccaugcauggcacucugcaccacagaccagaguugcccagauggguggcucggcugcgacugggggccagaaugagcgcaacaagcgcccacgaccacagggagguaacagcggcacaugcccugugcaccccaacagucgccacagcgccgccgagugccgcaagaucaucaagcucgcgaagugcgucagugaacggcgcgagcagucuuccaaggauggcuccccaccu

SEQ ID NO: 4619 - RNA, 99 nt, Zea mays
gacaggaucgcgcgcgacccgcagcuggcgcggcugcugcagagcaucccgcagcgcaaagugcuguucaccaacucggaccgcgcgcacauggagcgg

SEQ ID NO: 4620 - RNA, 75 nt, Zea mays
cgucggccuccuccuccgccgccgccgccaacgccggugaaggaagcgggggugcggaggagggcguggagauca

SEQ ID NO: 4621 - RNA, 66 nt, Zea mays; identical to SEQ ID NO: 4581

SEQ ID NO: 4622 - RNA, 66 nt, Zea mays
agcgccauguugacagcaacgaaauugugaaccaaccuuuugcgguuuugccuauaacauggcgac

SEQ ID NO: 4623 - RNA, 414 nt, Zea mays
uuggaggcuuccucgacagcuccagcggcugcauccaucucagcgaccuaaaccaggugaagaugacuuuaaaaaacuuuuuccugggaaggaaugaucuguaccuacugcaaauugauacuuucaagcuugcagauggguuaauuuaugaguuaagugauggugauaaguauuucccucauuucuauggcccuggucggagcuuugcaccucuucaacuagauacuguugugaaggcagacaaaauaaaguuugcagacaaugaauuuaccuguggucuacuugauggaagugaucucccaagcugaucuguagagucucaccuucaucuuagcaaugcucauuugaguucucugccaaaguuaugagauaaaugaugacauucgcgagcuguccgggaugacaucgaagaga

SEQ ID NO: 4624 - RNA, 94 nt, Zea mays
ugaucccucuugugucuccuggcgagcucuucauaccaucuucgagcgcgauuuggcgauggcggcggcgcagguggucgcgaaggggagcgug

SEQ ID NO: 4625 - RNA, 143 nt, Zea mays
gacggcggcucgucgguuguccuguggccggagcagcuccacgcgcagaacggcgccccggcgcggguggaggucauggagcccgucguugcgcucaccgccugcgccaacuccgucgccgccuguaaccacgaguccacgac

SEQ ID NO: 4626 - RNA, 61 nt, Zea mays
gcugagguuauccgccuggaacgcgugcuugucgggugcgccgccgguggaugacgcgccg

SEQ ID NO: 4627 - RNA, 271 nt, Zea mays
ccauacaggaucgcagcgcggugcgcgagagaggggucagcugguuggccaagaugagggagauccugcacauccagggcggccagcgcgguaaccagaucggauccaaguucugggaggugaucugcggucagcacugcgccgacugcacgggcuacucggcgaccuccuagcugcagcucgagcucgagcggaucaacgucuacuacaacguggcugggcgugaccguuacuugcuccgcgccgugcucauggaccuggagcccggcac

SEQ ID NO: 4628 - RNA, 220 nt, Zea mays
ucgguuuccuucacgaucgacugcaccaagccaguggaggacaagaucauggaggucgccucgcucgagaaguuccugcaggagcgcaucaaggucgccggcggcaaggcuggcaaccucggcgacuccgucaccaucucccgugagaagaccaaggucaccgucaccucugacgggcccuucuccaagaguggauguaggcgacgauggagagacuccg

SEQ ID NO: 4629 - RNA, 100 nt, Zea mays
agaagcgcgacggcgucagcggcgugaccgaccccgcgccgccggccgccaaggcucagguggugggguggccgccggugaggucguacaggaagagcug

SEQ ID NO: 4630 - RNA, 69 nt, Zea mays; identical to SEQ ID NO: 4571

SEQ ID NO: 4631 - RNA, 68 nt, Zea mays
agcggguuggucggcaauccugccucgccgaguugcucggcgggcggguuggucggcaaccccgccuc

SEQ ID NO: 4632 - RNA, 259 nt, Zea mays
cgucggcgcgacccgcggccacgcgcugcugaagaagaaguccgacgcgcugacgguccaguuccgcgccauccucaagaagaucgucgccgccaaggagucgaugggcgagacgaugcgcgccuccuccuucucccucgccgaggccaaguacgucgcuggcgacggcguccgccacgucauccuccaguccguccgcgcggcauccguccgcguccgcucccaccaggagaacguggccggggucaagcuccccaag

SEQ ID NO: 4633 - RNA, 93 nt, Zea mays
guuguugacaaggaugagagucuugcaaaguuugauccaguaaagcugaagaaacuugggccaacuuuuaagacgaaugguucuguaacggcu

SEQ ID NO: 4634 - RNA, 60 nt, Zea mays
cuacaacaaggacaaggccugggacgaccaauggaucuucuggguggguccacugauugg

SEQ ID NO: 4635 - RNA, 72 nt, Zea mays
auaggaucucguuaugcagcguagaauauuauuauauaguuuauuccuauguuugguguaauguuaauuuug

SEQ ID NO: 4636 - RNA, 124 nt, Zea mays
cccgaugacgcgacaggcacucgucacaggccaacgaccgaugagaucuuuaacaaccugaagaacgacgacggcgacaacaacaacaacgaugaucuguuugcgauguuugcguucggugaca

SEQ ID NO: 4637 - RNA, 125 nt, Zea mays
ggcagacagauauggcgggaagaaggugauggcaggugcugcugcgcuaugguccuuggcuacaauccucacuccgugggcagccucucgcuccaccaucauguugcuugcuguacgugcacuau

SEQ ID NO: 4638 - RNA, 87 nt, Zea mays
aaaccaaaaaggagaggaggggagccccggacggagaagagaacagaagaaaccccgcggccaccccuuccugccuauauuucucuc

SEQ ID NO: 4639 - RNA, 127 nt, Zea mays
ccaagcagcaguugucgauggcuugcuugcggcggcggaugcccuaucccagacgcggaaucgucugcauggugaagucgcguccgggauaggugucgccgcuacaggucuucgacaugcagcuaaa

SEQ ID NO: 4640 - RNA, 194 nt, Zea mays
ccgccuucuccgcaugucccuuccucgcccucgccgucguccuccucgccuugccggagcucgcagccggcgacacccacuacuacacguucaacgugcaaaugaccaacgugacacggcugugcgugacuaagagcaucccgacggugaacggggaguucccggggccgaagcuggucgugcgggaaggcgac

SEQ ID NO: 4641 - RNA, 77 nt, Zea mays
gaggauuggcuccuacuuccauggaucuccauaucaguccuguuuauggacggcgauggcaguaugaaacuuagcgg

SEQ ID NO: 4642 - RNA, 143 nt, Zea mays
cagaccuccgccugcggcuguuugggcacggggaaggacucgccggugaggcugcucucgucgaccucgcucugcccgucgacgaccacgccguccacgggcacgaccuccccggcccggacagcgacgacggcgcccacccc

SEQ ID NO: 4643 - RNA, 253 nt, Zea mays
acugcggccgggcgauggcgagcguggagggcaagagggagacggugcuggucaccggcgccagcggcuucaucggaucgacccucgucggccuccuccucgaccgcggcuacaacguccacgccagcguccucaaccccgaugacaaggcggagacggagcaccuggucgcccugggcgccggcgccggcgaaggccggcugcgcgucuucccgggcgaccuccucgacggcgccgcgcucauggccgccgc

SEQ ID NO: 4644 - RNA, 262 nt, Zea mays
uaaaacucagcaccgaccuccucguaguccuuuucaagcgccgccagauccucacgagccugggagaacucgcccuccuccauacccucaccgacguaccagggcacgaaggcgcgcuuggcguacaugagggcgaacuuggggucaaugcgggagaagaccuccacaacacugggggaguuggagaucuuacacacggcacgcugcaccuuggccagaucaccgccugggacgacgcugggaggcugguaguugauuccgc

SEQ ID NO: 4645 - RNA, 326 nt, Zea mays
ccagcggccguggcgcggcgcccuugcagcggaugcgcagagcuuccucccauggcguccuccccuuccuccuccuguuucacggcagcaagcagccucuccauggccgagcucgcccagcagccaugagagccucuucccaugggcgccacccccugcaacuuccccuugucggcgcccagaaaucgcagcagcaugcuccuuugccucacgcuugagugcucgacgaaaugccgcagcgagcagcggucaugagauccccucuguguugcuugcaucggcccgaucugcgcaguuccgacccaaggcgucgcguggguguuugg

SEQ ID NO: 4646 - RNA, 77 nt, Zea mays
ucguccccgcgugcgacaugcaggagccguugcuggcggagucguccgaccgcuucuccauguucccgauccgguac

SEQ ID NO: 4647 - RNA, 91 nt, Zea mays; identical to SEQ ID NO: 4603

SEQ ID NO: 4648 - RNA, 270 nt, Zea mays
acugugcucagauauuauccugucaggguucuaccauaaaaaacugccauugcaccagucaauccaacauuccuacccaggucugaugaugaacaggaaaugugugcgaggacuauuuacugcacaaacauugacaagucacucaggcagaucuguaauuguucuuugagucuauauguggagaggaaggaccgaguuuccaguagaugaagacgcucauaguguuggugacuguguaaaggaauccauaacagaugauucugaccacaa

SEQ ID NO: 4649 - RNA, 212 nt, Zea mays
guccugccuuugcaacgguacggggccuccgcgcggaggucggugcuccucggugcuccgcucguccgggaggauccgaguggggaucugccgaugggcugaugcuccacucgaaggugccgagguggaugcggcccgagaaguccccgucgccgacggggucaccgccaccauccgcgcucugggccuccggcucuuuguacuuguccucg

SEQ ID NO: 4650 - RNA, 77 nt, Zea mays
ugcgggggcucgggacgggaacgggacaggaccucaaaaucucagauccuuccugcccgcccgcccgugcccgucga

SEQ ID NO: 4651 - RNA, 72 nt, Zea mays
cgaugucgaagacggccgaguucguggucucuaagguggacgaccugaugaacugggcgcguaagggcucga

SEQ ID NO: 4652 - RNA, 193 nt, Zea mays
guucaagaacgcggaccaccaggcgguggugaacucggagugcagccgccuguccaucgccacguuccagaacccggcgcccgacgcgacgguguacccgcuggccgugcgcgacggggaggcgcccauacuggaccaucccaucaccuucgccgagauguaccgccgcaagauggcccgcgacaucgagcuc

SEQ ID NO: 4653 - RNA, 152 nt, Zea mays
gcaucgccgcgacgaugaggacugucuuauucgacgccaucgucgcccacgcguccgcgaaaacgugggcggacgcgugggcggacgcgugggcggccgcgucgacccgacgauggcgucgaauaagacgguccucaucgucgcggcgaugc

SEQ ID NO: 4654 - RNA, 203 nt, Zea mays
cccccggcggcgccgcugcugacgaccaguccgccccuggcgcacaccucgccaagcauugcgucaccggccgugucggagccuucguccaagaagcgcaaguccccggcgcacagggcguccgcccacaguggcagcaaccagcgucgccgcgccgaccaagacaggccaggugcugguagcagcagcggcggcagcaagag

SEQ ID NO: 4655 - RNA, 182 nt, Zea mays
uauuguggcuuccacaacuguaaagcagccccaauuaucauugugccugggaaagaagcuggugaacagucugugcuuugaaggaagaugaguaggagaguuguuccuguucguuguacugucaguuuaggugauaaaguguuguauauuggugcugguuuacaguuguggaagcuguacau

SEQ ID NO: 4656 - RNA, 128 nt, Zea mays
gaucaagcuccagcuccugauucuaagcgaggaucuggaggagccguaccaaacgggagaaucaggaggaucagcuccucacgaggaucaggaucuagaguuaaagaagcaggagcuggagcuuugcc

SEQ ID NO: 4657 - RNA, 91 nt, Zea mays
ucggcggccgcgguggcggcggccucgacgucgcggcgcugcaccuugacacagcgcaggcgcuuccgguugccccacuguaacagcaggu

SEQ ID NO: 4658 - RNA, 98 nt, Zea mays
aaccuugggacccuacugugggcggcccagaccccauacggggggguccggaucccauuccaggggucugguccguacacguggggguccuggaccaa

SEQ ID NO: 4659 - RNA, 59 nt, Zea mays
uuuucgaagccgccggacggaguguagcgcuagcuagcuccccaggccggagaggagga

SEQ ID NO: 4660 - RNA, 126 nt, Zea mays
ggaggccggcaugcggcgggugcaggugcgcguaaccggcaugacgugcuccgcgugcacgggagccguggaggccgcgcucuccgcccgccgcggcgugcgccgcgccgccgugucgcugcucca

SEQ ID NO: 4661 - RNA, 77 nt, Zea mays
ugcgggggcucgggacgggaacgggacaggaccccaaaaucucauauccuuccugcccgcccgcccgugcccgucga

SEQ ID NO: 4662 - RNA, 170 nt, Zea mays
gaguuuuugcagccuuagccaaaguguaggacaaauucaaucuugugagauagcaucuuggauaaccugucaccucgaccauguucgucguggccaguuguagacgucuugguugugcaagaaaguuucucucgaggacaguugcucguuuuguuagggccaucaauuuu

SEQ ID NO: 4663 - RNA, 85 nt, Zea mays
uuugaagggggaagaggcuggcgcggguauugacacugccuuacuuugcaggacuugccugugcgggccuccccacccgccaaac

SEQ ID NO: 4664 - RNA, 205 nt, Zea mays
gggucggaucuuccaggaguauugcgagggcaucgguacccagcucugcuucgcguacguggcuuaucccaggagcaacggucaaguggaaagggcaaaugcacagaucuucauaggacucaagacaugcaccuaugacugcuugaagaagcauggagcaaauugggucagugagcuuccguccgugcuaugggggaaccggaca

SEQ ID NO: 4665 - RNA, 269 nt, Zea mays
cccagaagaaucugcuaugaucaugaaggcuuagggaguuaaaaauguugauacgauguuuuaaaggacuggcacaacuaaguaagaacccuuaguaagaaccacuauuuuuaguuguccuuacuggauaaugggucaaguaaugaaagucugcauuuagggauugcugggcuuagccaaaaucuuguuguaccaaauuguguugaugggcugggaauuacaacuauauucggacuacgggcuauccauguucaugugauuuuuuguac

SEQ ID NO: 4666 - RNA, 176 nt, Zea mays
acaagaggaaggagcaggggaaaccgugugacagacccaacaucgucguuccccuucccagccauggaugcuggccgccgcuacccuucucuagugcucgcucaacccuuuguucccuucccaugccugaccucccucugcccuauccauggucguccccugcuccucccauggac

SEQ ID NO: 4667 - RNA, 135 nt, Zea mays
gagcuuuccugcuucucucuuggaucuaccugcugugguggagucauacaaaacauaugaugauucuguacuaauuaaaacugcugauguuggucaggcagagcugguuaaccaaguugagaagcaucuuaucag

SEQ ID NO: 4668 - RNA, 59 nt, Zea mays; identical to SEQ ID NO: 4659

SEQ ID NO: 4669 - RNA, 96 nt, Zea mays
uagacuucguagccgcggcgcuuggcgucccguuccucccggcuucgcuagccaacagcucggacgacgacgucgcgcgccgcggcggcgugaacu

SEQ ID NO: 4670 - RNA, 59 nt, Zea mays; identical to SEQ ID NO: 4659

SEQ ID NO: 4671 - RNA, 67 nt, Zea mays
auaggguugcuguggcaggggcagcugcguguuggacgacgacgcggugcccaugccguuggcaagc

SEQ ID NO: 4672 - RNA, 86 nt, Zea mays
aaggagggugcacuggcugaggagaacaugcguggaauuugcuuugaggucugugaugucguucuucaugcugaugcuauccacag

SEQ ID NO: 4673 - RNA, 160 nt, Zea mays
ucaccaucaacggcgugggcugcgucgucgagaccguguaccuggccauguaccugguguacgcgcccaagaugcugcuggggcucaacgucgccgucuucggccucgucgcgcucgucaccaugcuucucuccgacgccggccuccgcgugcacgugcu

SEQ ID NO: 4674 - RNA, 237 nt, Zea mays
uccgcaaggcggaagcgcgaggaacagugggccaccgagaagaaggagaaggcccuagucgagaagaagaaguccaucgagagccgcaaggcucaucuucacccgcgcaaagcaguacgccgaggaauacgaugcccaggagaaggaacuggugcagcuuaagcgcgaggcccguuugaagggugguuucuaugucaguccugaggcaaagcugcucuuugugguccgcauccgggg

SEQ ID NO: 4675 - RNA, 71 nt, Zea mays
uguaaaccuuccauuccguguucugccgacaaucaaggaauugggccgaacacgcauggagaucaacguga

SEQ ID NO: 4676 - RNA, 249 nt, Zea mays
guggcgcgacggcggcggucggucugguagggcuccccuccuuuccaccagaucagaacagauagucauagaucacuagaucagugucacaccacgacccgccagccggaccgccacuugccaaccaacgccuuucccuccuccuccgccuccgggcgcuagcgggaauggacgccgccgagcugccccucgucuaccacaucggucuggugcuggccgcgcucugggccgccgccgccgucggcuucc

SEQ ID NO: 4677 - RNA, 74 nt, Zea mays
accacaauuguugccguuuuaccagcacguggcgccuaacgcuggcacccucuuacaacugcaacaauugcugc

SEQ ID NO: 4678 - RNA, 250 nt, Zea mays
gaaagguaggcuguagugcgacaucugcucugccacguuucugcugugguggugccgugguggugugacuaaucaucagagauaaguagcaaaccgucaaccaccagggagacgagccaggcaaguuuauuuucaucucgcuaucucccugauauuggugucuagauugaagauuaugcaucagcgacaaguaacgaccgcccggaaagagagccagaaaaaagggcaggaaaucgccaccgcccgcccc

SEQ ID NO: 4679 - RNA, 191 nt, Zea mays
ccuccgccuccgcgccacccgacgcgaggagggcacgcagcgccacccgccgccgcuccgcccccggugacccucugcugccgccgucgcgagccauucaaaguccgauugcucuuggcuuccuccuccucccgggcgguggcugcgucucgcucgugcgcuucugcuuccucgguagccgguaggugagg

SEQ ID NO: 4680 - RNA, 60 nt, Zea mays
cuuccguugacccuugaagaaaacacuguggaguauuuucugauaagaggugugcuggaa

SEQ ID NO: 4681 - RNA, 65 nt, Zea mays
uucauaaauuguuaaauagggaaacuaaaauagaguuuuaguuucuauauuuaguaauuuaggga

SEQ ID NO: 4682 - RNA, 74 nt, Zea mays
gggcgauguguaggucaugaggcaccguuguagcuguuccaaauaugacuggcuguaugguuuaguugcugcga

SEQ ID NO: 4683 - RNA, 118 nt, Zea mays
cccgaugacgcgacaggcacucgucacaggccaacgaccgaugagaucuuuaacaaccugaagaacgacgacaacaacaacaacgaugaucuguuugcgauguuugcguucggugaca

SEQ ID NO: 4684 - RNA, 128 nt, Zea mays
ugguuuggguacucuaggaaugagacggauugaguggauugagauguauugggagaguuuuugaucuauuggggauuuaaacacucuuuaaucccuccaacuacuucaauccaagaguacccaaacua

SEQ ID NO: 4685 - RNA, 70 nt, Zea mays
caagcuggcaaucgggaaugcaccauggcccauuggagugacuaugguuggcauccccgagcguucugcc

SEQ ID NO: 4686 - RNA, 234 nt, Zea mays
gacgggcgacgacgacuacuggggcgcugucacgacgacuaugcagcaaaaucaucaucagcagcagcagcagaacgagcaguucgacuucugguccacggcguccgcgcugcagcaccugacuaccgccgccgccgaccaggaccucaccggcugggugcagggcuucuccgacgacggcauccuguccggcuccucgucggacagccucuggagccucgacgacaucuggag

SEQ ID NO: 4687 - RNA, 80 nt, Zea mays; identical to SEQ ID NO: 4614

SEQ ID NO: 4688 - RNA, 72 nt, Zea mays; identical to SEQ ID NO: 4554

SEQ ID NO: 4689 - RNA, 170 nt, Zea mays; identical to SEQ ID NO: 4662

SEQ ID NO: 4690 - RNA, 119 nt, Zea mays
ccuuucgccuaugauauccguauccgcacguuacgcuucgccgauacgcguauaucuucucuguaacgcguugacuacuucguagucuggcgugcgguaucacuaucaucgaccggcaa

SEQ ID NO: 4691 - RNA, 206 nt, Zea mays
caauggcggcgccgcugaugcuaccgguggugguuccggcgcuggcgguggacauggcgguggcgcagccggagcuccaagcuacgggacuggagguggccuuggcggaggcaagggcgaggccggcagcgacggguccugggguucagguuacgcggcgggaaucggugcuggcacuggcggcggcgguggcggcggaucgcaag

SEQ ID NO: 4692 - RNA, 58 nt, Zea mays
aaguuuguguaccaagacuauguauccucuugauguaucgcucuugguaaccuuuaau

SEQ ID NO: 4693 - RNA, 279 nt, Zea mays
  misc_feature (256)..(256): n is a, c, g, or u
  misc_feature (271)..(271): n is a, c, g, or u
  misc_feature (274)..(274): n is a, c, g, or u
gacggcaauggcacgaucgacuuccccgaguuccucaaccucauggcccgcaagaugaaggacaccgacuccgaggaggagcucaaggaggcguucaggguguucgacaaggaccagaacggcuucaucucugccgcggagcuccgccacgugaugaccaaccuaggcgagaagcugaccgacgaggaggucgacgagaugauccgcgaggccgacguugauggcgauggccagaucaacuacgaggaguucgucnaggucaugauggccnagngagua

SEQ ID NO: 4694 - RNA, 65 nt, Zea mays
caagcgggagggaucuggggcaugguggcggucgcugccgcugccgcucggaucuagagggccgc

SEQ ID NO: 4695 - RNA, 143 nt, Zea mays
aggccuaguuuggauacuuuaggauuagaguguuuuggagggauuggagaggguguaaauccccaauagaucaaauacucucucaauacaucucaauuuacucuaaucucacucauuacuagaguacccaaacuaggccuaau

SEQ ID NO: 4696 - RNA, 64 nt, Zea mays
cuaacuuuuucugccuaagguuaguucuucaauacgagcgacuaaccuuagccaaaguguggca

SEQ ID NO: 4697 - RNA, 236 nt, Zea mays; identical to SEQ ID NO: 4560

SEQ ID NO: 4698 - RNA, 75 nt, Zea mays
auaugguucaccaggcuuugcgccaugucccaauuaauucggguggcauggaugugaacuugguaucuucauuau

SEQ ID NO: 4699 - RNA, 67 nt, Zea mays
ggaggaggauggcccgugggguggugguggccauggcguccaccaucaacagggucaaaacugucaa

SEQ ID NO: 4700 - RNA, 73 nt, Zea mays
cugaaaaugagccgaguucgauucgguguggcuuggugagugacuggcugagcucgacucggcucgcccacuc

SEQ ID NO: 4701 - RNA, 262 nt, Zea mays; identical to SEQ ID NO: 4559

SEQ ID NO: 4702 - RNA, 124 nt, Zea mays
ugcucugaugcgacaggaugagcugcucgcguacauugacaggcaggagcugaucaaguuccguaaaaagaaguucugcuucuaagaucugaccauggagcagcuggucauguccggagccguu

SEQ ID NO: 4703 - RNA, 185 nt, Zea mays
gcccuguuuguuuacccucuagauuauauaauccagcuuaaauaaguugagagguaaacaaacaacacagauuauuagguggauuauguaaucuagauaccuagauuaugauaauccauaagcauaucaauaggugcuuauauaaucuauaagcuggauuauauaauccuggaaggaaacaaaca

SEQ ID NO: 4704 - RNA, 91 nt, Zea mays
uuggguuugucaaagcaaguugguugaauggcaucaauuguugcacuuguaagagggugccagcguuaggcgcaacgugcugguaaaacgg

SEQ ID NO: 4705 - RNA, 141 nt, Zea mays
  misc_feature (52)..(52): n is a, c, g, or u
accaaggaggacgucgcgugguacugcgggaagcggauggccuacaucuacnaggccaagaccaagagcagcggcacccacuaccgcugcaucuggggcaaggucgcccgcccgcauggcaacuccggcgucguccgcgcc

SEQ ID NO: 4706 - RNA, 74 nt, Zea mays
gcccaauaaggccuuaguucgguuugagauggauuaaagagauccaccucuaaccgaacaagccgacauggagg

SEQ ID NO: 4707 - RNA, 68 nt, Zea mays
gcaacaauugcugccauacaaccaguucucuuugaugaacccugccuugaaguggcagcaacccaucg

SEQ ID NO: 4708 - RNA, 161 nt, Zea mays
cccagcuuccacuccaucuccggcgucucccucgccgccgccgucaugucgcuuugcuacucgacgaucgcgugggucgccucggcgcacaaggggaggucgccggacgugcacuacggccugcgcgcgacgacggcgccggggaagguguucggcuucuu

SEQ ID NO: 4709 - RNA, 234 nt, Zea mays
gcagaacuacuacggcagcucgugccccagcgcggaguccacggugcgcuccgucaucucgcagcgccuccagcagagcuucgccguggggcccggcacgcuccgccucuucuuccacgacugcuucgucaggggaugcgacgcgucggugaugcugauggcgccgaacggggacgacgagagccacagcggcgcggacgccacgcugucgccggacgccguggacgccaucaa

SEQ ID NO: 4710 - RNA, 72 nt, Zea mays
gaacuggacuacuggugagucgcugcuggguuuucaugugcagcuagcgucacucagcuaacccccugucau

SEQ ID NO: 4711 - RNA, 193 nt, Zea mays; identical to SEQ ID NO: 4652

SEQ ID NO: 4712 - RNA, 71 nt, Zea mays; identical to SEQ ID NO: 4675

SEQ ID NO: 4713 - RNA, 68 nt, Zea mays; identical to SEQ ID NO: 4573

SEQ ID NO: 4714 - RNA, 73 nt, Zea mays
ccgucgcccggguggaggacgaacagcuacacccugaucgggcagcagcaguucgccuucccccgcauagcug

SEQ ID NO: 4715 - RNA, 179 nt, Zea mays
ucagacgacguucguggucaugcucaccgcugcggcugagcuggggaacuuggcgcuuggcaagugggcgcaugggcagguccuuacccgacguauugacaugacgcuucagcuuggcacggcuguggugaauauguacaccaagugcggcgaggugaguuaugcaucgugcuuguuug

SEQ ID NO: 4716 - RNA, 67 nt, Zea mays; identical to SEQ ID NO: 4671

SEQ ID NO: 4717 - RNA, 58 nt, Zea mays
ucaggaggugcaccggacagucugaugcccccaccgggcaguccggugccccccaaaa

SEQ ID NO: 4718 - RNA, 247 nt, Zea mays
guguggccauguccagcgugguggcuccggaugggacgcgugguguagccguggccgcgccugaggaggaugucgguggaggcggagaagaggauggcgguggcggcgucgauuucucuggcggcgccgaccgaguuagggcuuguggccaggucccgugccaguuccaccgcacgacgcaggcgcgccgcggcguggacgccgccgccggucacacgugggccucagagcuggacgaggccgcgcu

SEQ ID NO: 4719 - RNA, 77 nt, Zea mays; identical to SEQ ID NO: 4538

SEQ ID NO: 4720 - RNA, 73 nt, Zea mays
uccacgugugccgcaccguguucaacaccgaccuccgcggcgugcugggcauggugcggucccccugcguggu

SEQ ID NO: 4721 - RNA, 90 nt, Zea mays
ggcgcgagaagcggcgcguuuggcuccagcuucugcuucuggcggccagaagccgcccagaagcugaaccaaacagccgcauuguccggc

SEQ ID NO: 4722 - RNA, 75 nt, Zea mays
ugggucguucguaccaaguccuaugagccaauuugcuuccguaaacuggucucaaggaucgggugugaguuugcc

SEQ ID NO: 4723 - RNA, 74 nt, Zea mays; identical to SEQ ID NO: 4601

SEQ ID NO: 4724 - RNA, 169 nt, Zea mays
ccgccgccgccuccuccucgcagcuuccgccgcucuacucgucgccuuaugcggcgccgugcauggccggccagaugggccugaaccagcucggcccggcccagauccagcagauccaggcccaguucauguuccagcagcagcagcagcagcagaggggccugcacgc

SEQ ID NO: 4725 - RNA, 77 nt, Zea mays; identical to SEQ ID NO: 4538

SEQ ID NO: 4726 - RNA, 106 nt, Zea mays
gcgccggggacgcccagcugggcuaccgcuucgagcuggugcccgaccacaacagcaacgucacgggcucgggcgugugcguggccgaguccggcgucccggcggc

SEQ ID NO: 4727 - RNA, 84 nt, Zea mays
aaagcgacgcggcgcgagcgaggagggccaaggggaagaggggaagcaccgcaccaggacccuuguucgccgccgucgccucug

SEQ ID NO: 4728 - RNA, 70 nt, Zea mays
ucgacaagcacgaggaugccaugagcaagaugggcgccauacuggcuucaggcauccucgacgccggugg

SEQ ID NO: 4729 - RNA, 159 nt, Zea mays; identical to SEQ ID NO: 4565

SEQ ID NO: 4730 - RNA, 104 nt, Zea mays
uuaacgaggcccagucccgcggcggccguggaggcggcgguggcggauaccguggcgggcgcccugauggaggcggcuacggcgguggcgguggaggcuacggc

SEQ ID NO: 4731 - RNA, 179 nt, Zea mays
ucacuugccaagauucaagaucucucucaaacucagaaguugcgguuaucaguucagcaacauguuguacuggucuugaugggggacuugaagaaagaaaaccuuucagccgcuugcagaguucgguacuauauagggaugcugcuauguuuggcagaucuauggaacuuggaaguaua

SEQ ID NO: 4732 - RNA, 105 nt, Zea mays
gcgucgcuguguguguuucgagucagucagccaguuaguugcgugccauggcuggcaugcucugagucugagaugaugaugaugccugacggcggcgucugguac

SEQ ID NO: 4733 - RNA, 74 nt, Zea mays
accgucgcccggguggaggacagauaccugcacccuguccaggcagcagcaguucgccuucccccgcauagcug

SEQ ID NO: 4734 - RNA, 68 nt, Zea mays
gcaacaauugcugccauacaaccaguucucuuugaugaaccaugucuugucgaggcagcaacccaucg

SEQ ID NO: 4735 - RNA, 80 nt, Zea mays
gcucaaaagcgacuguuggucccaagccaugucgguucaggguggccaacauggugcggguguaggaguugccugcgagu

SEQ ID NO: 4736 - RNA, 80 nt, Zea mays
agauucuuuuaggccucguucguuuucagccgaucagcccauuccuguuccggguggaacgaauggaccugguuuggaau

SEQ ID NO: 4737 - RNA, 68 nt, Zea mays
uguucuggugccgaagcuccugcaauacuugguuaaacauguuuuugaggaccuucgggagacgaacg

SEQ ID NO: 4738 - RNA, 71 nt, Zea mays
guuauugcguggacuguuugcugcggugucuccuguuuguuuggguagcgcagcgucggccucuucaggug

SEQ ID NO: 4739 - RNA, 247 nt, Zea mays
ucacuaaauugucaaauauggaaacuaaaauagaguuauaguuuccauauuuugcaauuuauagacuaaaguggaauaaaauggagggacuaaaaauuagucccuaguaaccaaacacuaccuuaggggguguuugguuuauagagacuaaacuuuaguccauccacuuuauucuauuuuaguucauaaauuguuaaauagggaaacuaaaauagaguuuuaguuucuauauuuaguaauuuaggua

SEQ ID NO: 4740 - RNA, 323 nt, Zea mays
cugcacaacgcggcgcgcgccgacgugggugucaagcccgugucguggaacaauagccuggccacguacgccgagagcuacgcggagacgcgccaggacgacugccagcucaaguucuccgacgggcccuacggcgagaaccucuucuggggcgccgccggcaccaacuggacggccgccgacgucguggggcuguggguggcccagaagcaguacuacgaccacgccaguaacaccugcgcugcaggaaagaagugcggcgccuacacgcaggugguuuggcgcgguaccaccagcaucggcugcgcugccgucgucugcag

SEQ ID NO: 4741 - RNA, 271 nt, Zea mays
cuucuccuucacccgcaacauccuccaggggaagcccaucacgguguacaggggcagggaccgcgucgaccucgcccgggacuucaccuacaucgacgacaucgugcgcggcugccuggcgucgcuggacacggcgggccggagcaccggcaccggcggcaagaagcgcggcccggcgccguaccggaucuucaaccuggggaacacgucgcccgucacggugcccacgcugguguccauccuggagagguaccugcgggugaaggccaag

SEQ ID NO: 4742 - RNA, 70 nt, Zea mays; identical to SEQ ID NO: 4542

SEQ ID NO: 4743 - RNA, 220 nt, Zea mays
caucuaucucaacgcuggaucucuguuucacuugccgcgagccauauaugguucagggccugcucgcguguuccggauccugauuaccggugccaaauugcugccugauccaggcuaaccugcggauccuggucacugguggggcgggcuucaucggcucgcaccucguggacaggcucauggagaacgagaagcacgaggucauuguugcugauaacuu

SEQ ID NO: 4744 - RNA, 159 nt, Zea mays
cggagggaguccggcgaccguggacuggccucuccggcgaagcagacuucgauuccucgcucggggagcuucaccgaggugugcucaguccucuccgagggucggacgggguugggaagggcuugguuggccggucuacgguggcaggggcucgggugg

SEQ ID NO: 4745 - RNA, 75 nt, Zea mays
gccgcgcgauccgacccaggccgacgccgacgaccccucucgccgccggcggccauggcguacggcgaccgcguc

SEQ ID NO: 4746 - RNA, 68 nt, Zea mays
ugcggcucuaucugaggguuuccuccguccuggauucgggaaggaaggcgcccuuggauuuccgucuc

SEQ ID NO: 4747 - RNA, 84 nt, Zea mays
acaguauucuuggggaggguggguucgguuauguauucaagggguggauugagccaaacagcacugcuccugcaaaaccuggca

SEQ ID NO: 4748 - RNA, 97 nt, Zea mays
guuaagaucaucggccauucgguaagcccauucucgcaccgcgucgaggccgcucugcggcucaagggcgugccguaugagcugauccaggaagacc

SEQ ID NO: 4749 - RNA, 73 nt, Zea mays
ucucugucuucacaacugacgaucugugugugguacgcaccacgcacgcaagucgcgguugugcguguacguc

SEQ ID NO: 4750 - RNA, 147 nt, Zea mays
ggacccggacaaggugacgcgcgucagccucggggagaaggcguucgagaaggccaucgucucccauggcgaucacgucgucagguucacgcagcggaaccuacugcgcauuuucccgcggucgacgcgcaucacuucguccaacua

SEQ ID NO: 4751 - RNA, 63 nt, Zea mays
ccaggcggugucccgguuccggcgcgucaucaaccugcuggaccgcacggggcacgcccgcuu

SEQ ID NO: 4752 - RNA, 87 nt, Zea mays
gccuugauggcggcggcggcuacggcgguggcggcggcggcuacgguggcggcgguggcuacugugguggugguggcggcuucggcg

SEQ ID NO: 4753 - RNA, 74 nt, Zea mays
caauggcggcgccgcugaugcuaccgguggugguuccggcgcuggcgguggacauggcgguggcgcagccggag

SEQ ID NO: 4754 - RNA, 130 nt, Zea mays
uuaugcccuauuaauuaaggguuuggucuguauaacuaauuuuuagucucuuuauuuuaaaauagaagaacaaaaugaaacuaaaaauuaguucuuugaaaccaaacaccccauuaguuuuauaaguuaa

SEQ ID NO: 4755 - RNA, 76 nt, Zea mays
ucuggaugacgcagucggacgucggguacgcgacgcaggugagcgcguacccggcaccgaccugcgccucgucgag

SEQ ID NO: 4756 - RNA, 64 nt, Zea mays
ugcagguguuccaucucucgaccauaaccuuugugguuuggucaggcuggaucucccaucugca

SEQ ID NO: 4757 - RNA, 77 nt, Zea mays
cccgccccugcgcagcgcggccccggcccagcgcggcuucggcucgcgcggccguggugccccugcguagcguggcu

SEQ ID NO: 4758 - RNA, 101 nt, Zea mays
augggaauguggaucuugaaagaauuaacagagcauacauggugcucuugcacaagaaacagggguguacgucuguugacucuuuuaggccgaucagucuu

SEQ ID NO: 4759 - RNA, 60 nt, Zea mays
ugaucugcauguuggauuaaugugggcuuggcccaaauuaauauucaauaauagucaaug

SEQ ID NO: 4760 - RNA, 157 nt, Zea mays
ucaacgaggcccagucccgcggcggccguggaggcggcggcggcggcuacggugguggccguggaggcggcggcuacggcgguggcgggcgccgugauggcggcggcggcuacugcgguggcggcggcggcuaccguggcggcgguggcuacggugg

SEQ ID NO: 4761 - RNA, 70 nt, Zea mays
caagcugacaaucgggaaugcaccauggcccaucggagugacuaugguuggcauccacgagcguucugcc

SEQ ID NO: 4762 - RNA, 82 nt, Zea mays
ccagccuucacaaggcuggugaucauccuuuucguccgaaugcuggaggaagaggcgggucaccagcucauguggaagacgg

SEQ ID NO: 4763 - RNA, 91 nt, Zea mays
cuggguuugucaaagcaaguugguugaauggcagcaauuguugcaguuguaagagggugccagcguuaggcgcaacgugcugguagaacgg

SEQ ID NO: 4764 - RNA, 229 nt, Zea mays
acagggugauggagauggagucuuugccgagugucccuugcaacacucggcaaagaaguuaccuuugccgagugucagccugacagcacucggcaaagaauccgccagaggggguccccaugucauguacuuugccgagugcuugguauggcacucggcaaagcgugcuucuuugccgagugccauagacauuacacucggcaaagaaccuauaccggugcccaggucu

SEQ ID NO: 4765 - RNA, 77 nt, Zea mays; identical to SEQ ID NO: 4538

SEQ ID NO: 4766 - RNA, 157 nt, Zea mays
ucaacgaggcccagucccgcggcggccguggaggcggcggcggcggcuacagugguggccguggaggcggcggcuacggcgguggcgggcgccgugauggcggcggcggcuacagcgguggcggcggcggcuacuguggcggcgguggcuacggugg

SEQ ID NO: 4767 - RNA, 93 nt, Zea mays; identical to SEQ ID NO: 4633

SEQ ID NO: 4768 - RNA, 67 nt, Zea mays
gcauuagagcuuguucguuucuaccccaauccauauggauugagggagauugaggggguuccaaucc

SEQ ID NO: 4769 - RNA, 61 nt, Zea mays
aagccugggggcuggguacaccaugagagcugucucacugagucacuaggucgccaguucg

SEQ ID NO: 4770 - RNA, 75 nt, Zea mays; identical to SEQ ID NO: 4745

SEQ ID NO: 4771 - RNA, 131 nt, Zea mays
aagggggggggguuuccacggcaucccgacggggacugcgcaaauugacggcgaaacaagacacggaaacgucgggguugcacggaucaacaacgcggcugcucucgaugcggaggggauccggggcugcu

SEQ ID NO: 4772 - RNA, 67 nt, Zea mays; identical to SEQ ID NO: 4592

SEQ ID NO: 4773 - RNA, 72 nt, Zea mays
augcacucuggcuggccuagacugcccccgauccaugguggccgguacgucuugucgagcucuugcaugucg

SEQ ID NO: 4774 - RNA, 70 nt, Zea mays
cggaucuccucgguccgcguucaggauaugcagcaacuuggguauuuuggcagcggaguggggcguguua

SEQ ID NO: 4775 - RNA, 282 nt, Zea mays
aggacagcaagcugggugugaagggccuggucgacuccggcgucaaguccaucccggccauguuccaccacccgccggagucccucaaggaugucauuucuccaccagcucugcccuccuccgacgaugcgccggccaucccagugguggaccuguccguggcgcggcgcgaggaucugguggcccaggugaagcacgcggccgggacggugggcuucuucuggguggugaaccacggcgugccggaggagcugauggccagcaugcucagcggggugcgcc

SEQ ID NO: 4776 - RNA, 71 nt, Zea mays
cggcgccggugcguuaguggagucgucgucgagggugucgcucggcugcaucgguggcgacacgggcgcau

SEQ ID NO: 4777 - RNA, 113 nt, Zea mays
auuuccucaugagagcuaguuuagugacuagagaucaugggugaauagcaaggggauucuuuuccauggauccucucgugauggaucaccaaauuagcccuuacgaggggauc

SEQ ID NO: 4778 - RNA, 225 nt, Zea mays
gccagauccagucguggccaacgccaacacagcgcccccuccccacgacgcugaagucccagaucuaaccacacagacacaacccaccacgucgccaccaccaacuaacccauuaauccaucaacgccgguccuccacggucacgcggaagucaccgccgcucugccgcgcucucccguagucccguaccgcaucgcguucuucgcuggccucgcugucgucuca

SEQ ID NO: 4779 - RNA, 145 nt, Zea mays
auggcggacuggggcccggugaucgucgcgacggugcuguucgugcugcugacgccggggcuacugugcacgcugccggggcgcgggcggguggcggaguucggcagcaugcacaccagcggccucuccauccucauccacgccg

SEQ ID NO: 4780 - RNA, 244 nt, Zea mays
caggacuauuaggcuuuguuuggguacuuuaguauugaucccaauccaaauccauauauguuaaggccuuguucgguuauucucauuccauauugauuggaguguaucggaauggauuuuaacaugcuauggauuuaaacaaacucaauaucauccaauccacauggauugaugaagaaaugaauaagcccuaagguggauugaggucaauaguagaauacccaaacuaggccuuaguuggagg

SEQ ID NO: 4781 - RNA, 172 nt, Zea mays
uagagucaccuguagagagaauccuaguggucugugaguacccugauguuuucccagaugaauugccagggaugccacccgauagagacauagaguuugcaauugagcugcaacccggaacugcaccuauaucuaagagacccuauaggaugccuccagcagaguuagcaga

SEQ ID NO: 4782 - RNA, 66 nt, Zea mays
gccgcuugggcgccaucucucuagagcuucguacccucgaagagagauccggcgcggcccaauaaa

SEQ ID NO: 4783 - RNA, 73 nt, Zea mays; identical to SEQ ID NO: 4749

SEQ ID NO: 4784 - RNA, 292 nt, Zea mays
cccgagcgggggcaauaagguaguguggaugucaauuguggugcaugugccugggucuagugcuacaaacuguggaccacccauuccaaguuguguaguggguuucggaugccuuggugaaagccuuugcaucccaacaccuaaagugguggacauugcgugaggcuggcuucacagagcagcgaguaccgcccgccaccagcgguggaaggauaaugagucgcuaugcuauaggccaauugaggcacaugugcccucucugguagaccacuaucuuuuugcuauuuuucuu

SEQ ID NO: 4785 - RNA, 99 nt, Zea mays; identical to SEQ ID NO: 4619

SEQ ID NO: 4786 - RNA, 74 nt, Zea mays
aguaacagcauccaucgauccacaguccaugcugguugaugcaugggucugcuggagccgaggaugaacacagc

SEQ ID NO: 4787 - RNA, 60 nt, Zea mays; identical to SEQ ID NO: 4759

SEQ ID NO: 4788 - RNA, 237 nt, Zea mays
auggccgagccuucccugaugugcaccacaguuggcggaguggucgccugcgggauucacgguggagcagguagccgaggccgagcucgggcgaggcggagacgguaccugagggcgagcccagcgucgggcgagacggagauugcaccagagggcgagcccuacguuaggcgauacagauguuugucugagauggaggacucucggggaggggucucggucaugauagcguuuaug

SEQ ID NO: 4789 - RNA, 73 nt, Zea mays
cuccaccggaccagcagcggcugaucuucgccggcaagcagcuggaggauggucgcaccuuggcugacuacac

SEQ ID NO: 4790 - RNA, 72 nt, Zea mays
cgggcgcagcggaguccaguuugucugcugccaccuggcauggaggaacaagcgaagacucuggagacgcaa

SEQ ID NO: 4791 - RNA, 263 nt, Zea mays
cgugacgauggccuucauggcuccaauccaccucggugccgcccucgcuccccgcccaugccgagcccgaggagggcagcgacgccaagguggaagggacaggcaacgcuugcgguugcugugaaaucgcugagcagggagacagucgccgcguuggguaguccggcuugggcgcggcggcguggacugcugcggguccaucgguguuggcgcgggagcgcgugccggggucggagggcgucauggaccggcucuuucgucgg

SEQ ID NO: 4792 - RNA, 65 nt, Zea mays; identical to SEQ ID NO: 4694

SEQ ID NO: 4793 - RNA, 227 nt, Zea mays
uggcaggacacaaacugguacgugacaggccaucaaagcggcgcgguuaagguauggaagauguugcacugcucgucugaugaagcaguaaauagcaagagcaaaucaccugcgguauugucuggugggcuuagccugaacggccaagcaccagaguauaggcuacuucugcagaaggugcucaagucacacaaacacccugucacugcccuuuguauaccaccgga

SEQ ID NO: 4794 - RNA, 135 nt, Zea mays
cucaccaccuucggugcuuucgcauauggcauguaccaggucggucaggggaacaagguccgccgggcgcucaaagaagagaaaauugcugcucgcagugcuauacugccgaugcuccaagcagaagaggaugaa

SEQ ID NO: 4795 - RNA, 70 nt, Zea mays
cuucuuugugcacugucgucccuucgucuaccguacaacagaucaagggagagcggugucuccgaaccac

SEQ ID NO: 4796 - RNA, 306 nt, Zea mays
aacgagaacgagcagcuggcguucgggccggggcugguggugccagggaucuacuacucggacgacaagaugcugcagugccggguguucgccuacgccgacacgcagcgcuacaggcugggaccaaacuaccugaugcugcccgucaacgcgccgcgcugcgcgcaccacaacaaccacuacgacggcgccaugaacuucaugcaccgcgacgaggagguggacuacuacccguccaggcacgcgccgcugcggcaggcggcgccgcccacgccacugccgcccaggccagucgccgggaggagg

SEQ ID NO: 4797 - RNA, 134 nt, Zea mays
gacaggaucgcgcgcgacccgcagcuggcgcggcugcugcagagcaucccgcagcgcaaaguggugcguauauucagaacagaacagauggaagcgagcuguucaccaacucggaccgcgcgcacauggagcgg

SEQ ID NO: 4798 - RNA, 77 nt, Zea mays
uguucuuucugucucggucgcugcaugcgacuggcuaauaacaaaggaagaugacagcgcugaagacagcucucaaa

SEQ ID NO: 4799 - RNA, 196 nt, Zea mays
auuaaggucuguuuguuuacccucuagauuauauaauccaguuuaaauaaguuaagagaaacaaaacaacacagauuauuagguagauuauauaaucuagauaccuagauuaugauaaucuauaagcaggucauuaggugcuuauauaauccauaagcuagauuauauaauccuggagagaaacaacagggccuaa

SEQ ID NO: 4800 - RNA, 71 nt, Zea mays
gaagcacaggccccaguugcugaggaggacgacgacgaugauguugaccuuuuuggugaggagaccgaaua

SEQ ID NO: 4801 - RNA, 62 nt, Zea mays
ugccgcagcucugacacaggcacaacacaccggccuguugaccgugucggacaacccguuug

SEQ ID NO: 4802 - RNA, 211 nt, Zea mays
acugcggccgggcgauggcgagcguggagggcaagagggcgacggugcuggucaccggcgccagcggcuacaacguccacgccagcguccucaaccccgaugacaaggcggagacggagcaccuggucgcccugggcgccggcgccggcgagggccggcugcgagucuucccgggcgaccuccucgacggcgccgcgcucauggccgccgc

SEQ ID NO: 4803 - RNA, 66 nt, Zea mays; identical to SEQ ID NO: 4581

SEQ ID NO: 4804 - RNA, 183 nt, Zea mays
uugagacuucaagacaugccuugggcaucaaguguuuauagcauacuucuacuucuaauccgggacucaaacaauuauaagauaaagaugcaugcagcuguugcucuaucagugccagugucaaggcuugauuacagcagcucauuuccagauguuguucgaggccucgugcaugcucucgag

SEQ ID NO: 4805 - RNA, 72 nt, Zea mays
aauguucuauauuacuggccuggauugguuugaacagccaaccuucaguaguuaguggugguguuacuguaa

SEQ ID NO: 4806 - RNA, 89 nt, Zea mays
gggaugggaugcgaugggaugggacuugggagaagaagccaaaacucuuuucuuucuuucuuucuuucuucuuauacguaauuauuacu

SEQ ID NO: 4807 - RNA, 118 nt, Zea mays
guggccccgucgaacuuaagguuaagaacgugggugccgacgaacuuaugggaaaacauccgacggcccccgggaacuuaaaaacccacguucuuaaccuuaagcuugaaggcaccca

SEQ ID NO: 4808 - RNA, 253 nt, Zea mays; identical to SEQ ID NO: 4609

SEQ ID NO: 4809 - RNA, 77 nt, Zea mays; identical to SEQ ID NO: 4538

SEQ ID NO: 4810 - RNA, 66 nt, Zea mays
gccauaacacucggcaaagaaucaagaccugggcaccgguauagguucuuugccgaguguaauggc

SEQ ID NO: 4811 - RNA, 182 nt, Zea mays
agaggaacccugcguuuugcgagaagaaggccaaucauucaacgcucgucuauguucguagcgaugcacaaaucggaaucaccgucguucuugcaaaccccgauuggguuuguuuauggaccgagagaugacgaucgugcaagugauguggugucacccacaagaugcagucgguggacgac

SEQ ID NO: 4812 - RNA, 292 nt, Zea mays
cgauugguugaugcacauaguaaucuuggaaaucugaugaaagcucaaggcuuuauucaagaggcauacaguugcuacaucgaggcguuacguauugauccucauuuugcaauugcauggucaaaccuugcuggucuguuuauggaggcaggagaccucgacaaggcuuuaauguauuauaaggaagcuguuaagcuuaagccaucuuucgcugaugcauaucuuaaucaagggaauguuuauaaggcuuugggaaugccucaagaugccauuauguguuaucaacgugcac

SEQ ID NO: 4813 - RNA, 67 nt, Zea mays
cuaguucuagcuagcuagcaaagggggggaaaauggcuccgcuucucgcugcugccaugaaccacgc

SEQ ID NO: 4814 - RNA, 72 nt, Zea mays
gggaguacaaggucaaggaucucucgcaggcggacuucggccgccucgagauugagcuggccgaggaagaaa

SEQ ID NO: 4815 - RNA, 87 nt, Zea mays; identical to SEQ ID NO: 4638

SEQ ID NO: 4816 - RNA, 330 nt, Zea mays
guuuuacuccgcgcgcucggcccagcuaguggagacggcgccgacgcgccgacaggcgggggccccuugauaggcucgcucucucgcacucgugcugcugcuccgcggggcccaccagacagucccucaacaccuacgcgcuaccgucuucuccgcgcgacacccaccuccgugcaugccucuaccagccguaagcuccggauuccauugcagccgccucguaccccaccucgccuacaaauaucggaccccacgaccucgcccgcugcucccauuuucuugccgccgcuucuccacgccauccacugcgccggcacguucugugcggag

SEQ ID NO: 4817 - RNA, 80 nt, Zea mays
ucaucuuccucuccauccuccucggcuucggcuucuacuuccucggcaagcacuggggccgggaggagagcggaccggcg

SEQ ID NO: 4818 - RNA, 133 nt, Zea mays
uuuuuuuucgggcacucggcaaagaagcucuuugccgaguguuauuuuuuugacacucggcaaagagcucuuugccgagugucaaaaauauaacacucggcaaagagcucuuugccgaguguuuuuuuucaac

SEQ ID NO: 4819 - RNA, 170 nt, Zea mays; identical to SEQ ID NO: 4662

SEQ ID NO: 4820 - RNA, 64 nt, Zea mays
cacccgcccugccggcguucgaguuccucuauucggggcuuggggagcucggcgaccucggcuc

SEQ ID NO: 4821 - RNA, 193 nt, Zea mays
  misc_feature (56)..(56): n is a, c, g, or u
  misc_feature (84)..(84): n is a, c, g, or u
  misc_feature (87)..(87): n is a, c, g, or u
ggccuuugugcuaaaccagcaucagccggcggagcaugaugagucgagcagccagngaacugacguaacugugugagcuguagnagnaacguacuucguguuacguagaagaauaaggagaaaacgaccaauccgguuauaucuggaugucauguauggucgacggucguugcuggcuuggcuuccgaagacg

SEQ ID NO: 4822 - RNA, 109 nt, Zea mays
gguucguaucuaaaugugccacacuuugccuaagauuagucguucgaauugaagaacuaaccuuaggcauaaaaguuaggcaaaguguggcaacuuaggcauaaccaaa

SEQ ID NO: 4823 - RNA, 215 nt, Zea mays
gucagagaggcggcggcgaugucugggcgcggcaagggcggcaagggucugggcgagggguggcgugaagcgcaucucggggcucaucuacgaggagacccgcggcgugcucaagaucuuucucgagaacgucauccgcgacgccgucaccuacaccgagcacgcgcgccgcaagaccgugaccgccauggacgucgucuacgcgcucaagcgcc

SEQ ID NO: 4824 - RNA, 68 nt, Zea mays
gcaacaauugcugccauacaaccaguucucuuugaugaacccugucuugucgaggcagcaacccaucg

SEQ ID NO: 4825 - RNA, 75 nt, Zea mays; identical to SEQ ID NO: 4745

SEQ ID NO: 4826 - RNA, 99 nt, Zea mays
uuucuuuaagcagcaugguuggacagaugguggaaaaauugaagcaaaguauacuucaagagcugcugacuuguaccgacaguugcuugcuaaagacgu

SEQ ID NO: 4827 - RNA, 133 nt, Zea mays
gacgucgcgugguacugcgggaagcggcauggccuacaucuacaaggccaagaccaagagcagcggcacccacuaccgcugcaucuggggcaaggucgcccgcccgcauggcaacuccggcgucguccgcgcc

SEQ ID NO: 4828 - RNA, 234 nt, Zea mays
ggggaaaugggaaugggaaugugcuuugcagggaggggaaugagaaugauagauauagaaugguggcagacuggcagaacaugggaauggacugugcgcgggaggagggaaucggaaagggggacaggccuugccacugguugguugcugaaggugaaaucacuaucuggcaguggcccacaaggccuaguuuguauuguaguugcaguuuccuggaaaaacaaauuuguuuag

SEQ ID NO: 4829 - RNA, 69 nt, Zea mays
cagccaugcgggggaaggcgaacugcugcugcccggccagagugcagcauuccguccucuguccgggcg

SEQ ID NO: 4830 - RNA, 172 nt, Zea mays
uguuuuggguuuauaccuugcagcaugccacugcacaaucuugacuugcugugcuacuuugauuagcgagugugguguaaaauguacgaacaacuaacacccgagcugcuagcuucagauuaaagcaagcuguucaaacugccgcagcuguaauccauagagacaaaacacu

SEQ ID NO: 4831 - RNA, 193 nt, Zea mays; identical to SEQ ID NO: 4652

SEQ ID NO: 4832 - RNA, 64 nt, Zea mays; identical to SEQ ID NO: 4756

SEQ ID NO: 4833 - RNA, 76 nt, Zea mays; identical to SEQ ID NO: 4550

SEQ ID NO: 4834 - RNA, 72 nt, Zea mays; identical to SEQ ID NO: 4651

SEQ ID NO: 4835 - RNA, 205 nt, Zea mays
ugguucauuuaagcugcugcuguaccuggguaucugcgucgucuggugcccucugguguaccucuauauggaugucgucgucuaauaaacaucugugguuugugugucaugaaucgugguuguggcuucguugguuuaauggaccuguuguguccucuguguuguacccaaaacucuucugcagcaguauggcuugaauccuuau

SEQ ID NO: 4836 - RNA, 68 nt, Zea mays
gaaaaaaacuggugcugcaaugucugcucguaaacuugcucgcagugucauugagcauuccgcuacaa

SEQ ID NO: 4837 - RNA, 61 nt, Zea mays
agcauggcuauccuaauggcguucagagcacauacucuggaaaucauugggcucacgacca

SEQ ID NO: 4838 - RNA, 327 nt, Zea mays
uacaucguuuuuaggggauguuugguuuguagggacuaauguuuagucccaucauuuuauuccauuuuaaacucuaaauugccaaauuuagaaacuagaauaaaguuuuaguuucuauauuuagcaauuuugcaacuaaaauggaauaaauuguagagacuaauguuuagucccuccauuuuauuccauuuuagucccuaaauuacuaaauauagaaacuaaaacucuauuuuaguuuccuuauuuaacaauuuaugaacugaaauggaauaaaguggagggacuaaaguuuaguccauauaaaccaaacacccccuuaguaugguu

SEQ ID NO: 4839 - RNA, 236 nt, Zea mays
gcuuuguugcugcggaggcaaucccugucgccugcucccuccccaugagaguaccacgccacgcacacccuucaggaacgccguaagcugaagcuuucagucggcugcugaaaccucgaucguucaucagucagucuccaaggcgguucgaucguggccaucaucagccgagcugcacgauggcuaccuacuacucgagccagggcagugaaagggagccgucgcagaacauguac

SEQ ID NO: 4840 - RNA, 69 nt, Zea mays
gcugcuccugugucguugucaaggacuacggugaagaaucugagggccuuaacauagugcaggaguaug

SEQ ID NO: 4841 - RNA, 71 nt, Zea mays
guuuuauggugccaauuauaugcccucuuuauuucauucugagcgagagguguaagaaagcacccgcuggc

SEQ ID NO: 4842 - RNA, 65 nt, Zea mays
gggacgacaacgaggagcugagcugcaucucguucggguucagcaucggccuucgucgcguccag

SEQ ID NO: 4843 - RNA, 94 nt, Zea mays
ccuggaugggguuggcaucggugagcagguggaugaucuccaggguaugcuugaugaugcgaacagccaugaccuucuugccguuguugccccc

SEQ ID NO: 4844 - RNA, 458 nt, Zea mays
cgcuagagcuaauaguuagcuguuagaauuagcugguggcauccaaacaacucagcuaauaguuugacuaguagcuacuuuuaguuggagacauccagaguuccaaacacccccaacuaaauaguucagcuaacuauuagaugcacccucgauaccuauuaguucauuagcugauucaaccuaccuaaaaucagcuaaggggcuguuugguucgcauauuuguaacgugauggguaacugaugacguuaaauuauguuugucuaaguccaaccguaauuggauaccacacuagaaagugauaccgaccuauucaaauucauuacuguugauauuugagcgugagucauuaucauuaccauuuacgguauauuuuaugaaccaaacggcaccuaauaauuagccagcuuauugaacucguaauuucuuagccaacuaacuauuagcucuaauguauuua

SEQ ID NO: 4845 - RNA, 78 nt, Zea mays
gcgcuucguucguacuggcuagugcagugcgggggaucaacgucgcccccucgcucgcgcgguuaucgagcaguuagu

SEQ ID NO: 4846 - RNA, 109 nt, Zea mays
uggcgggggggcgcgucaagcagggggaggcggggcgggugaucagggucgccgaccccgugcgggagggccggaugccgccuccucuucuugccgcgccggccacgcc

SEQ ID NO: 4847 - RNA, 156 nt, Zea mays
guucacaacagaaguugggucuccgauaucaugggugcucucacgguccaagugcuguuugaauaucuccacaucugggagcugcuggaggaggugauaauccagcccgacacccuggauacucuuguuuggaggcuuucuucuucgggaugcuau

SEQ ID NO: 4848 - RNA, 180 nt, Zea mays
uucaggggaggggcgucgggugugcggcaugccggagaaggcgcagcugcacguggcgaugcugcugcugcaguucggcuacgcgggcuuccacguggugucgcggcuggcgcucaacaugggcaucagcaagcucgucuuccccgucuaccgcaacaucaucgcgcucugccugcucgu

SEQ ID NO: 4849 - RNA, 208 nt, Zea mays
acgaaaaccgaccauucauuccuucuuccauggcgaggagggcgacggugauggugcucgcggcggcgcucgcgguccuccugcuggcgucgucgucgucgaagacggcccccguggccagcgccgcccgggacgaccccucggcggcggcggcggcggccgucgucucuucuucucgugaccagaaggauggaucggcggcggcggc

SEQ ID NO: 4850 - RNA, 134 nt, Zea mays
auggagccuuugccgagugucagucuagcaggcacucggcaaagggagcuccaguggggccccaugccaguuucuaugcuaaacucugugucgaguguguggcugacacucgacaaagauuucuucuuugccga

SEQ ID NO: 4851 - RNA, 69 nt, Zea mays; identical to SEQ ID NO: 4840

SEQ ID NO: 4852 - RNA, 82 nt, Zea mays
auugcucgcagcgcuagcuucuugcgcucaucacucgucucccgaccaagaucagcaaggacggcauggcucucgaagcagc

SEQ ID NO: 4853 - RNA, 93 nt, Zea mays
aucuuggcauuuauccugcuguugucaccaagacugguuucugcuuuccggaacaccacgcuuuaggugguuagguagguaagcaaaaaggga

SEQ ID NO: 4854 - RNA, 83 nt, Zea mays
cgcaccucaagggcaacguggugcucgugcgcaagaccgugcucggcuuggacgucacuaguaucgccggcucccuccucgac

SEQ ID NO: 4855 - RNA, 72 nt, Zea mays
  misc_feature (44)..(44): n is a, c, g, or u
gcugguucgcgcgucguucacgcuggucgcgcgcaccguuuggnugugucgucagcgugcuaugucgugcuu

SEQ ID NO: 4856 - RNA, 111 nt, Zea mays
gacuuuacaugggcaacggugguggcgccaauguugucgcaccuggcuacaccaagggugauggccuuggcgcugagauuguuggcaccuucauccuagccuacaccgucu

SEQ ID NO: 4857 - RNA, 469 nt, Zea mays
guggagcucaucgcauccauccaccacgcaccccaccaacccauacccauaccagaggcucucugauuuuacuucuccgcgguagaucggcugagcgagcgagcgaggcacacggagcuagcuaaacagagcacacggguagaaaagcaagaugucggacggcacggcgaccugcaucgacaucauccucgccaucauccugccgccgcucggggucuucuucaaguucggcugcgggguugaguucuggaucugccuuauccucaccuuccucggcuaccuccccggcaucaucuacgccgucugggccaucaccaaguagccggccggagcagaugaaccacgguccccugccagugccaggcagcuagcugugacuccgucgcgugcguuagcaugcaaugcaagcgcaggguggucucguggggggacguggugugcgcgugucuugagaugugauuccuuccuu

SEQ ID NO: 4858 - RNA, 104 nt, Zea mays
guggccagagaucacgagggaucaaugagagaguaauccauugcuauucaaauugaauagcaaggggauucuuccccauggaucccuuugugaucuuggucauc

SEQ ID NO: 4859 - RNA, 93 nt, Zea mays
agacuuucaauguuccugccauguaugucgccauccaggcugugcuuucccuguacgccaguggacguacaacugguauuguauuggacucug

SEQ ID NO: 4860 - RNA, 266 nt, Zea mays
acaugggugauggucgacgaugaaggugaagaucauguagguucgugccgaugggcugggagcggugaaggacaagcguugacccuugaucaaggaacugaagaagucaggaucauguuugucccagaaacuuuucgaagucuuuugugugcuacuuggaguuuuggaggccagggugugacuuugggauucaagacaaaguugcaugagcgcaaaaauucuacaggcucucauucaccaccucucuggucgacuauucgcuccuu

SEQ ID NO: 4861 - RNA, 63 nt, Zea mays
ucgccugaccggcucaguugcagcugcagcaggagcagccgcagcuggugccgcaguugcagg

SEQ ID NO: 4862 - RNA, 167 nt, Zea mays
gggguguuugguuucuagguacuaauuuuuagucucuucauuuuauuuuauaaauuaucaaauacgaaaacuaaaauagaguuuuaguuuccguauuugucaauuuagagacugaaauaaaauaaaauagauggauuaaaaauuaauccucagaaaccaaacacccc

SEQ ID NO: 4863 - RNA, 104 nt, Zea mays
guauugacucaucuacauguguugagguggauugauguguaaauuaguuuaaguuacaucccaugaucccaauccaccucaauacauguggauuguggucaaua

SEQ ID NO: 4864 - RNA, 221 nt, Zea mays
ccgacgaagaccauaggcuugcggcagucgucgaguuucuucaaguacgguucgacgaucuugacaugcgucacgcacccgaacgauguagacaacugcguugauggccucccccuagaacaugccagggagauccuuugccuugagcaucgucuuggccauggccaugacaguuugauuucgucgcucgacgacgccguuuugcuguggcguguacggcg

SEQ ID NO: 4865 - RNA, 167 nt, Zea mays; identical to SEQ ID NO: 4862

SEQ ID NO: 4866 - RNA, 155 nt, Zea mays
cacacucggcaaagaaacuugugccgagugccaaacacucgguaaacaacgggccucggcaaagcgccaucaguagccaucuaaagcugacgaccguuaucuuugccgagcgcugggcuuuggcacucggcaaagaagccucuuugucgaguguc

SEQ ID NO: 4867 - RNA, 88 nt, Zea mays
cucacacccggcaagccgucgugcucggcguguuuucucugugcggccuuacggguuccucucgcuucaucggcuugucgcguguuag

SEQ ID NO: 4868 - RNA, 74 nt, Zea mays
gucauagcacucggcaaagauggcacaccuggacaccgguaaagcuucuuuaccgagugcuauggccucgacac

SEQ ID NO: 4869 - RNA, 79 nt, Zea mays
auggcgucgcccccuuccauccauggcagguccgcgccccuacgccccaaaucacgcggauggaaggggucgcgaggga

SEQ ID NO: 4870 - RNA, 71 nt, Zea mays
gcaagcuucaaggaacuuaguaucgguggcuuaggguugcaagucacuguuuauugguccugcuucccauu

SEQ ID NO: 4871 - RNA, 89 nt, Zea mays
caagagccuguucuccgccgucgccaugucgucccgaacaccauccaaggugaaaccaacggacgacgucgacggggagcagaagguca

SEQ ID NO: 4872 - RNA, 107 nt, Zea mays
cucuuaauccauauggauugaaugggauuggauggguuugaacccaaacaagucaaacuucuucucaauuuuuuccaaucucauccaauccauguguauugggaaua

SEQ ID NO: 4873 - RNA, 113 nt, Zea mays
  misc_feature (26)..(26): n is a, c, g, or u
gguucgcggcuaacugugcuacacunugucuaagguuagucgucugaauuaaaagacuaaucuuagccagaaaaguuuagcaaaguguggcaaguuagguaguaaaccaaaca

SEQ ID NO: 4874 - RNA, 400 nt, Zea mays
gggcgcuagccguggcagcggaaguggaggcggagggaucaucguuguuggaggcgaggccgaggugguggagaugcagucaauggacguggucggggaugggacgagggccaaagcugcggcgagacgugagggucggagacucggagggcgucgugaggcggguuugggggagcaggcacaagugcgcgcgggagaugcgccuccaaaccacccucgcgcucuaccacuccggucguguagcuccccagcaggcaaccaccaucgcgcacccaccggccaccgcgucuacauuugccaaucucugcuugaagcguucugcccacucuuucaaccgagaaguucacuauuauccugcgcauguucccuuucccccuuucgucguggcacgcacguuagg

SEQ ID NO: 4875 - RNA, 322 nt, Zea mays
agcaguucacgugggugcugcugcugcgcgcucaccgcgccguggggugcguggccuggcucgcgggcggcuucuggggcguccugggcgccgugaaccgccgcgugcgccgcagccgcgacgccgacgacgagcccgacgccgaggccuccggccgcggccgggucaugcugcgguuccugcgcgcguuccugcugcucucccuggccaugcuggccuucgagaccguggcgcaccucaagggcuggcaguucccgcagcaccugaugccggggaaccugcaggagcuggaggagcagcugcagcaccugccggagcaccu

SEQ ID NO: 4876 - RNA, 157 nt, Zea mays
gaggauuugagggacccggcggccugugaggcacuccgccccauuuuucgggaguugaguaauaaacuauaaagucguaccuaaucaaaaugggguggggcaaauaucuuuccugguguagguuucucauaggaaaccgaggccccuacuuuccuuc

SEQ ID NO: 4877 - RNA, 75 nt, Zea mays
cgguugugucgcagcaucggauggguagcagcgcccaaccaggcagccgcgcuugccgaugcuguacgcgcugug

SEQ ID NO: 4878 - RNA, 67 nt, Zea mays
guuauuuuuuauuugccguguuuuaguucaaaagugaauuagcaggugacaaauauucaagaaugga

SEQ ID NO: 4879 - RNA, 168 nt, Zea mays
uggacugauuagguuuaauagguuugucuugcuguuuauaauuauauuuaauauuucuaacuuauguauaaauaucagaugucauauggacuaaaguuuaaaguggaaccauucgacagaacauaaguuuuacugugcaaaugcauauauuuauuaaaaaaugacguu

SEQ ID NO: 4880 - RNA, 90 nt, Zea mays
gcuggccagaucaugucauuuacuauuaaccauugcaucugcaauuugcuagacuauuugguuaaguaggaaugaugugguuuuuaauaa

SEQ ID NO: 4881 - RNA, 295 nt, Zea mays
agcugcugcaucaggggauguggcucgacaacgaugauagcugucaagacccccuucuucguggacuggauuguuuuggagguuugggcauuugacgggggcaagacggauguucaagcucguuggugaagaauucgaacccucgugugggguguguugaggcuuggcaacgacggcgcaccgcgaucuuccuccuucugugacgguguuuggauguaggcgucgucauguuuucuuuguccaugugcggcccgucuugcggagucagagcugcuugucccuugggucgagcucg

SEQ ID NO: 4882 - RNA, 271 nt, Zea mays
cucgcuucacgcugugucgcgcgaccucgaggcguaccccucgcccuguaucuacacucagauugaggcagcaguugguacagaagaggaggcuggggaaucaaauccugaagcaaaugaacuagagcuaucuagaguaucugaaaugaggcucauacuagcggaccccggucaacguauccucuugaauuauguuguuucauuaaaagauuucuuuguucaagcauguguguaugccuugagcuugaugauggaguucaagugagugcug

SEQ ID NO: 4883 - RNA, 74 nt, Zea mays
cuguucguaaucuggcgcaucucgcaccgcaacccggacgcgcuguggcugugggugacgucgaucgcgggcga

SEQ ID NO: 4884 - RNA, 136 nt, Zea mays
gaagaauaaauauacuuuacuagguguuguuuucagaaggaacaauugugggucgaauuuccacaguuaauggugauaagccacauauuaauguacuacgcauuuugaucagaucuguacggugugauucaccuga

SEQ ID NO: 4885 - RNA, 62 nt, Zea mays
gcugcuacaguugcuugccccugugccaaacuggcaggagguagguagcuuauagcauagca

SEQ ID NO: 4886 - RNA, 156 nt, Zea mays
gcaaaccaugcgguccauuagauuacgauccaaccacagauauaacuauaauuuguuaugguuuuuuauaaagauuauugaguugguggugaaaagguuuaaguauuaaaugucaccuacggaugaaucacgaucuaauggaccagcauggcaugu

SEQ ID NO: 4887 - RNA, 196 nt, Zea mays
accugcucaucgugggucggcgcggcggggaaggcgaaggugacccggagggguccacggcgcucaccagcgggcugucggacucgagcgaguucccggagcugggcgugcugggggacaugcucgccuccgcggaguucgcguccaaggucuccauccucgucauccagcagcagccgcccaagaaaaccaucgc

SEQ ID NO: 4888 - RNA, 68 nt, Zea mays
gggaagacggucuggaacucggggucccugcacacgcagauccagugguuccaggacaugaagcccaa

SEQ ID NO: 4889 - RNA, 207 nt, Zea mays
cgaggagagggcagcagccauggcggacgcgguggaugcccgccgggucugcgggaugccggagaaggcgcagcuccacguggcgaugcuggcgcugcaguucggcuacgccggcuuccacgucgugucccgccucgcgcucaacaugggcaucagcaagcucgucuuccccgucuaccgcaacaucaucgcgcucuuccuccucgu

SEQ ID NO: 4890 - RNA, 69 nt, Zea mays; identical to SEQ ID NO: 4840

SEQ ID NO: 4891 - RNA, 75 nt, Zea mays
cggcuaccagccccagccaaggcgcaguccggccucagacggggcggcgacucccugguggcggcuacugcugga

SEQ ID NO: 4892 - RNA, 669 nt, Zea mays
ccgcgcgggcaucgccgaguucgucgccaccuuccucuuccucuacaucaccauccucaccgucaugggcgucuccaaguccaccuccaagugcgccaccgucggcauccagggcaucgccugguccuucggaggaaugaucuucgcgcucgucuacugcaccgccggcaucuccggaggacacaucaacccagcugugacuuucgggcuguucuuagccaggaagcugucccugacuagggcccucuucuacaucaucaugcaaugccugggugccaucuguggagcuggaguggugaagggcuuccagcagggacuuuacaugggcaacggugguggcgccaauguugucgcaccuggcuacaccaagggugauggccuuggcgcugagauuguuggcaccuucauccuagucuacaccgucuucucagccaccgaugccaagaggaaugccagggacucccauguuccuauccuugccccacugccaauuggguucgcgguguuccugguccaccuugccaccauccccauuacuggcacuggcaucaacccagcuaggagccuuggcgcugccaucaucuacaacagggaucacgccuggaacgaccauuggaucuucugggucggccccuucauuggcgcugcucuggcugccaucuaccacca

SEQ ID NO: 4893 - RNA, 61 nt, Zea mays; identical to SEQ ID NO: 4837

SEQ ID NO: 4894 - RNA, 173 nt, Zea mays
guuugaacguacuagagcuaauaguuaguugacuaagugaaauuagcuagcuaacaaauauuuaucuaacuauuagcuaauuugcuaaaaauagauaauagcuaaacuauuagcuagacuguuuagaugucauagaugucaucagcuaacuauuaucucuagugcgcucaagc

SEQ ID NO: 4895 - RNA, 69 nt, Zea mays
gcugcuccugugucgucgucaaggacuacggugaagaaucugagggccuuaacauagugcaggaguaug

SEQ ID NO: 4896 - RNA, 81 nt, Zea mays
cgggcgccgucgugucgcuguucgcggcgggcgagggcgagcucguggccgucaagucggccggcggcgcggcggcggcgg

SEQ ID NO: 4897 - RNA, 147 nt, Zea mays
gcgacagagacuuugccgagugccgagugucuacuguacgggcacucgacaaagaagcuccccgugggcccauuugccauuaccuuugucgagucugccuucuuugccgaguacuauggcacuaacacucagcaaaguaccccuuug

SEQ ID NO: 4898 - RNA, 97 nt, Zea mays
aaaaaaaacugaggggauuggaggggcuaaauuuuauuuuuugauuaauuuuaaauaagaaggagaaucuagccccuccgguuucucgcucccaauc

SEQ ID NO: 4899 - RNA, 174 nt, Zea mays
ucuccuacacucgcuacaugcugcugcucccugacggcacucuaguugaagaagguuauaaugauucaauuuuucuuaauaauuucauaaaaucaggaagaaaaauugauacaucacaacauucuucaacaagaguaucgucagggaguagcagcauguagcgaguguaagaga

SEQ ID NO: 4900 - RNA, 189 nt, Zea mays
aggacaacgccgucuaccgcaccauggucgcucgcgagggcgccaucccgccccucgucgcccucucccaguccuccuccgcccgcaccaagcucaaaaccaaggcggagucgcuggucgagaugcugcggcagccgcggagcccgagccuccgcgcgcgaccagcggcggugguugcggcggagugac

SEQ ID NO: 4901 - RNA, 96 nt, Zea mays
ggauuauaaucugcccagauuauauaaccuaucuuauuuugaacuaaguguuaguucaaaauaaguuagauuauauaauauggacaaauuauauuc

SEQ ID NO: 4902 - RNA, 63 nt, Zea mays; identical to SEQ ID NO: 4861

SEQ ID NO: 4903 - RNA, 180 nt, Zea mays; identical to SEQ ID NO: 4848

SEQ ID NO: 4904 - RNA, 77 nt, Zea mays
aaucgggaucgaucucggcacgacguacucuugcgucggugucuggcaguacgaccguguugagaucaucgccaacg

SEQ ID NO: 4905 - RNA, 75 nt, Zea mays
uguggguggacgugccggacugcuucugcuuccaccuguggaacgcgugggaggagcccggcacgggggaggugg

SEQ ID NO: 4906 - RNA, 251 nt, Zea mays
aaguuugucucucuucgugcugggugauggauuugucucguuuggacuuccggccgggggauuuaagguccucucgcuugcugaccggguuuuccgcuucacaguuucuuccaaggauguuggguuccacauuuacaacucuagaugcauuguucguccggaauucaaagcuuucuucaacuuguggaacucugguggaccaaauuggaauuaugaauucagauuauuccuucaagaggagaaggccaacu

SEQ ID NO: 4907 - RNA, 112 nt, Zea mays
acagauaucgaacuugucaagugauuaugugcauuuacaggguuguccgagguccguuggacaaggacaacuguaggcgggccuaaugacuugggagguuccgucacacuuu

SEQ ID NO: 4908 - RNA, 444 nt, Zea mays
cacacacacacacacacacagacaagugguuuccaaagccaaguguguguacuagcaaccagcuagcucgggcggcagcaggcagccaucaugucggaggagaagcaccaccacuucuucaaccaccacaagaaggacgaggagcagcccgccggcgaguacggguacuccgagaccgagguggucaccgccaccggcgagggcgaguacgagagguacaagaaggaccacaaggacgccgaggaggccagcggcgagaagaagcaccaccaccucuucggcugaccguaguaccggccggcgcgcgaccgagcuagcuagcuccggcgcacacaaccacacaccuguuuaauucuguacugcaugcguguguaauuugaugguucacaauaaugagucccucuccggaccuugguagcugcuugcuuguggugagugagagug

SEQ ID NO: 4909 - RNA, 70 nt, Zea mays
ccuccuuuuuucuaguugucgcuggauaguuuaauuuugcacuauccaacgacaacuaaaacgaaacgga

SEQ ID NO: 4910 - RNA, 418 nt, Zea mays
ggugagcucaucgcauccauccaccacgcaccccaccaacccauacccauaccagaggcucucugauuuuacuucucagcgguagaucggcugagcgagcgagcgagcgaggcacacggagcuagcuaaacagagcacacggauagaaaagcaagaugucggacggcacggcgaccugcaucgacaucauccucgccauuauccugccgccgcucggggucuucuucaaguucggcugcgggguugaguucuggaucugccuuauccucaccuucuucggcuaccuccccggcaucaucuacgccgucugggccaucaccaaguagccggccggugcguuagcaugcaaugcgcgcgcagggugaucucguggcgggggacgcggugugcgcgugucuugagaugugauuccuuccuu

SEQ ID NO: 4911 - RNA, 106 nt, Zea mays
cauaaucuaguuaucuagauuauauaauccaucuaauaaaauguauuguuuguuuaucuuucgacuuauuuaagauggauuauauaauuuagagggcaaauaaaua

SEQ ID NO: 4912 - RNA, 395 nt, Zea mays
uucgucgauauaucuuugugucuccuguguuaacccagagcccgaacucuucacgucgcgucggccgucaauuggcauucccacugcgccgccgucggaucgacuggguccccgccgccgaugggcuucuuccgccggaucgccggcuuccuaggcaucucgcgggacgacgccgaccacccggacuccccgaccuccgucggcggcgccgcggcggcggcggaacucccucaugacagggcagcggcgcacggggugaggcagggguucagcgucaagguuccuguccaugucgagcggcaggugcccgugcccgugcuggugcccugcccgcagggggacggcggcgugcaggguuuuaggugguacacaaggaggcuuaggaucgaugaaga

SEQ ID NO: 4913 - RNA, 67 nt, Zea mays
cgcgcucuccacggucgccauggucaucucggccaucgucgaggaccggcgccgugccaucgcgcug

SEQ ID NO: 4914 - RNA, 99 nt, Zea mays
gcuagccgcacucggcgacugcacggcaaaacgcuacugccacggggcaguuuuagcguaucgaaaacugcugcagcgggagacugguggaauggugac

SEQ ID NO: 4915 - RNA, 63 nt, Zea mays
ugcugcuucaguugcuugccccugugccaaacuggcaggagguagguagcuuauagcagcuag

SEQ ID NO: 4916 - RNA, 74 nt, Zea mays
cuguucgugaucuggcgcaucucgcaccgcaacccggacgcgcuguggcugugggugacgucgaucgcgggcga

SEQ ID NO: 4917 - RNA, 255 nt, Zea mays
auggagcuugacugcgccgucgguggucucgcuuccggccuuccgccccuaucgcgcgucgaccgcuuccuggacaaccgcgucauggguugcaugugcucaucggaagcgucguggcuggacaaacugacgccuaguaucgagccuggcugggcgcaagggcaggggcacacuguguuggggggacggcugcuagcauuucucgccgccguuguggaccaugggaccuucggggcgcgccgucagcuuggauag

SEQ ID NO: 4918 - RNA, 133 nt, Zea mays
caauuuuuaaucccucccauuuauuccacuuuaauaaccaaauuggcaaauauggaaaccaaaauaaaauuauaauuuccauauuuugccauuuauaaaccaaaggggaauaaaauagagggaccaaaaauua

SEQ ID NO: 4919 - RNA, 74 nt, Zea mays
gaugcugccgggcaaggccucggugucccaccucguuuguggcggggggcgcuggagcccggucugguuggguu

SEQ ID NO: 4920 - RNA, 184 nt, Zea mays
cuuguguguaguuaagaggucacgcuguuguuguuguuguuguuguugacauucaagcagacauuuuguucuauucugguguuauuguuuuaaaaaaaaaaaaaaagggcggccgccggagcugagaacggcgggugcaagugcggcggcaacugccagugcgaccccugcaacugcggcaagu

SEQ ID NO: 4921 - RNA, 150 nt, Zea mays
ugcaccaauaagggcauguucgguuacaccaauucagaaggggaucggaggagauuaaauucucucauaaucaaaaaugacuagaagggaaauuaaaccccuccaauacccuucuggauugauguaaccgaacaagcccuaaaaggggaa

SEQ ID NO: 4922 - RNA, 96 nt, Zea mays; identical to SEQ ID NO: 4901

SEQ ID NO: 4923 - RNA, 142 nt, Zea mays
uauaugauguuugaaugcacuagagcuaauaguuggcaguuauccaaaaaguuauaguaauuuuccuaaucuuuccaaaaaguuaugaaucacucuuuuuggugguuuaaaucuucgguuauagguauuugaaguauggauu

SEQ ID NO: 4924 - RNA, 69 nt, Zea mays
uuguuuuguuaaaacuaaaucuggacauagccauaugagcugcugcccuguuugguguugccagcacua

SEQ ID NO: 4925 - RNA, 68 nt, Zea mays
ggcaugcucggcacgggcgcgcauggcagcucgcucuggggcaacggcagcgccgugcacgaguacgu

SEQ ID NO: 4926 - RNA, 165 nt, Zea mays
ugcacaaacaaugauugugcauugcaacaacauaauggcagagacgacgcuuucugaaaguucugcagacgcaacgaucguuccuggaucacgcgggcgugguaaaaauauaucacaauauacugccgagcauaugcuuuuaagaccauagucauuuuuugugaa

SEQ ID NO: 4927 - RNA, 87 nt, Zea mays
gcuauuucauuauauucauacauaugcaucuugcaucucauuuaggaccgagagaggaugaucgugcaagugauguggugccaccca

SEQ ID NO: 4928 - RNA, 81 nt, Zea mays
ucgucgguggaaucugaggguaccgcaguguucgucucgucgagaucuucguccuggugccuucgauucgucgaucuaacc

SEQ ID NO: 4929 - RNA, 144 nt, Zea mays
aaaucaaauuuagggguuguuccguuaggggggguuugaaaaauauugggggggauuaaaccccccuuuuuuguuuagaagggaaauuaauccccuuuaauucccuuagaccccgacccaaacgaacaagcccuaaaggggggg

SEQ ID NO: 4930 - RNA, 118 nt, Zea mays
cggcagagggugcgugcauccauggccacaaagcuagauuagggauuacagauuacuuaccggauuggggccuugggggcaguguguucguccguggucugcacgugcagcccggcag

SEQ ID NO: 4931 - RNA, 159 nt, Zea mays
aucuucuaccuaggccaaaugagauggagucuguggcauguuuugguuugaguccggucauuccaugauuuuuauuggagcuggucuuguggcaauugagcaucuugagccuaggccaaucuagauggaggacuccuaguuuuauuggcgaagauguuu

SEQ ID NO: 4932 - RNA, 90 nt, Zea mays
ggcggcggugcuggcgcacccgcucccgcgcccggcacccaggccggccacgcggcgggcgcgcagggggggcgucggcgucgucagggc

SEQ ID NO: 4933 - RNA, 134 nt, Zea mays
ggaggggguguuaaacgggcuaguaguagauguuauuuuaaucaaguuaguucgugaaaaaaaauaucacgguggcgacacgugcccgcuugcgugucacaugcuccugcgcucgcccguuggacacacuauug

SEQ ID NO: 4934 - RNA, 110 nt, Zea mays
agccucacgcgccguacgaagacgaagucgucgacgauguccucacagcaggagagcuugcugagccagagacacaaggcagcuucuuugccguaccgguccggcuuucc

SEQ ID NO: 4935 - RNA, 267 nt, Zea mays
ucucaucugugccgccucuucgugccguccggguccggcguccaugacuggcugccacugaucaucuacuuccacggaggcggauauguccucuuccguguggccuacgaucuguuguacgacaccugcauggcgcucacugccaccaccuuggcuguugucgugucuguggguaccaaaccguaggagaauagaggccuguuuggacagacgccguaggcgccgcagcacgccacaccugcggcggccgauuugggcgccacaccc

SEQ ID NO: 4936 - RNA, 415 nt, Zea mays
cgcggacgccacugaggauggcgaagucaucggcguuucagcagaagaacagcuacagcugcgggccuugcgcaucaagaaccgcaaccugcagaagcaaaaggagauccucgaggccaagcgccaacgugucucugugcaggccaaggugcgccagaugauacgugacgaggagcagaaggcucaggagcuugagcaagagauugcgcucaugcagagcaaaggccaacuuggucugcaacaaggcccacccuuucaacagcgcgcgccauucgaagaccuguucauuccucagcgcggacccgucaucccgcacgccgcagcauuccaaggugucaacuaccuugacgagcggaguccccuggcgccccaccugcaagugucaccauggcccgccaacuucagggcagggacc

SEQ ID NO: 4937 - RNA, 61 nt, Zea mays; identical to SEQ ID NO: 4837

SEQ ID NO: 4938 - RNA, 132 nt, Zea mays
cccgcguguccaugccuucuaccuccccgguaccuucaugcacaccuacuccccuggagaggugauguuagcaccuagcuugggagaucaggagaagaaggugcucggugggagaagacguggagaagaagu

SEQ ID NO: 4939 - RNA, 277 nt, Zea mays
uagggugcguuugguugaauggacaaagagggacggaacgaggcggacacaguaucagucauguuuggaugagggucaagcaggggcgaguugaaccccagaccauuuuucgguggcggcaccguccccaaaaaacaagcggaugaagucgcccccgccccugucgcggugcugaaaaaucguguugccucccaacaagugacaaaacccccaucccaaaccaaaaacuugguuggguuccaucccaaguuuuauucccuuucaacccaaacaaaaa

SEQ ID NO: 4940 - RNA, 78 nt, Zea mays
cguuuucguucguacuggcuagugcggcgcgggggaucaacaucgcccccucgcucgcgcgguuaucgagcaauuagu

SEQ ID NO: 4941 - RNA, 64 nt, Zea mays
cucuccgccgccuggcuucggcgaucugcgcucgcggaucggcgaaggcucgcguggcuguggg

SEQ ID NO: 4942 - RNA, 140 nt, Zea mays
ucuucuaucuggcucuaucucugugucucuggaucugcugucguuggaucuucucuaucgccgacggaacuggugcuccggccuucggcuaaggucgaggucguggccgugagggaccaggugccgacgauggagcauag

SEQ ID NO: 4943 - RNA, 73 nt, Zea mays
ugguugugaacaugcuaaguuugcuguuuauuggaauccgucuugagcagcaauuuggauuuguucgcauugg

SEQ ID NO: 4944 - RNA, 69 nt, Zea mays
aaucccuaaauuacuaaauauagaaacuaaaacucuauuuuaguuucccuauuuaacaauuuauaaacu

SEQ ID NO: 4945 - RNA, 72 nt, Zea mays
aacaugguuagaccaggaaccuucacgagcuguagaauuuaguucuuguuggucauuugugugugugccuga

SEQ ID NO: 4946 - RNA, 145 nt, Zea mays
aaacaaggccuuaggguuagugugggaauucuauuuuuucaagugauuuuuauuuuucaaaggaaaaaugaacuaauuuccccuuuaaaauggaaauccccugggaaaaugagguucccaaacuagcccuuagaaauacucuuug

SEQ ID NO: 4947 - RNA, 63 nt, Zea mays
cuuguggcuauugcacaggagcuguccggugugccaccggauaguuuggugcacccacggaca

SEQ ID NO: 4948 - RNA, 131 nt, Zea mays
agugcucgcuggacggcgucgucgaccuggaggccgggcuggcugagaucgucaaggccagcccggacaaggccgagaggaacugccgcaucugccaccucggccucgacagcgccuccgccgaguccggc

SEQ ID NO: 4949 - RNA, 107 nt, Zea mays
guuauuccuaucccauauggauuggaugggauuggaaaaaauuaugaaagauuuugacuuguuuaggauugaaacccacccaauccacauagauugagagcaaaacg

SEQ ID NO: 4950 - RNA, 182 nt, Zea mays
auaacucuuuuagugacagauggcacuccuggccugcagauaugcagggagaaggauaggaauccccaacuaugggaagauguucaucauauugauggggcccuuauuauuaauauuggugauuugcuagagagguggacgaauugugcuuucagguggcuuucuuucuugauccaaauccu

SEQ ID NO: 4951 - RNA, 77 nt, Zea mays
aaucggcaucgaucucggcacgacguacucuugcgucggcgucuggcagcacgaccgugucgagaucaucgccaacg

SEQ ID NO: 4952 - RNA, 63 nt, Zea mays
agcuuaccugugcaacccaggucuauggacccauccaaggaucuugcugcauauggguauggu

SEQ ID NO: 4953 - RNA, 251 nt, Zea mays
guucaucgguuucuugauuuuuuuucucucgucuccguuacugugguaauuagcagucgguaauuaguaaucacguugcagccuucuggcgaguggucaacaacaacaacaaaaaugcaaacaguaaacuaauacguauagcaauaacaaaaaagauacuaauaacaaaggugguggcguacauacagacaagacaagcagccagcuagagccaggugaggugaaaugaaggacaggaggagagguauggc

SEQ ID NO: 4954 - RNA, 74 nt, Zea mays
cccucuucaucggcucgguggucgucggcaucugcuacggcgugcggcuggcggucaccgugcccacggcgucg

SEQ ID NO: 4955 - RNA, 69 nt, Zea mays
gaugcuuaaaugguccauauccuggagcgggacacaaacugcugccuguauggacucgugcgauucagg

SEQ ID NO: 4956 - RNA, 121 nt, Zea mays
guuagauauagaucuaaccauaugucauauuuagcauuuaaauccucucacugccgccuuacuuuauaaaaaagcuccuaacaaaucacgauuacacauacgguuggaucuuagaucuaac

SEQ ID NO: 4957 - RNA, 72 nt, Zea mays
uagagcggccacaggugcagcugcgguggcaacuguaugugcgaccccugcaacugcugaucacaucuaucg

SEQ ID NO: 4958 - RNA, 112 nt, Zea mays
uccacuccgcucgucugacaucucgucccguccuuucguuucgaagccucgcgagccccgacgauggccaccgccgcggugucggucgacgagaagcucgacaagcuucgcg

SEQ ID NO: 4959 - RNA, 160 nt, Zea mays
gccaagaggccuuggccacgccguuggccacaacgcgguacucggccucaucgcugaagcgcgagacgacgaaaugccgcuucgcgguccaggagacgagguuggcaccuaggaacacgguguaaccaaaguggaucaacgcgugucagggcagccggcc

SEQ ID NO: 4960 - RNA, 74 nt, Zea mays
gaugcugccuggcaaggccucggugucccaccucgucuguggcguggggcgcuggagcccggucugguuggguu

SEQ ID NO: 4961 - RNA, 197 nt, Zea mays
ugggcccuuggaagguggcaugggguauucucugcuauaaaauggagaagcugcgcaggcgauaggcaucaaugaaauauucagaagacaucccuuccauauugugcuucuaccucuucagucucuuccuccuaucuucuagaguucuacuucuccguauagauccuuagcucguugcaacuuuccuuuccuaucgu

SEQ ID NO: 4962 - RNA, 103 nt, Zea mays
aaaaauguacucauuacuugugugccacuggcccuacauauaauacacacaaaaaaguuauauauauaccacucaguggcauguaaggaaugaguauaaaauu

SEQ ID NO: 4963 - RNA, 81 nt, Zea mays
agaggaaagaaucuuuuagagcgugcuguaaaggacagagaauauuccuuuagaggauggaauuuagggggcgcugcugga

SEQ ID NO: 4964 - RNA, 70 nt, Zea mays
gauuaaucgugauuaaucacgauuagucggacgauuuggacgauuaaucgugauugguccaaacugacuu

SEQ ID NO: 4965 - RNA, 388 nt, Zea mays
ucgcccucgccacuucgccgccgccgcuuuggcuccacccaguccgcuuccggcauccgcccauggcugcggcccccgcccgccaccucgccgcggccuucacggccgccgcugcgcaccagcgcgucgcguucaggcgcguccagguccgggccccgguguccgccucucucuccuucccgccgcgccaucccgcgacauuucgcggcagggccagccucgccugccccgccgccgccucucuauccguccccuccggcgccgcgccuccgggcuccgugccauucaaccuccugccgcccgacuccgacccuuucaucgagugggacccgcccccgggcgacuccgcccccucgccgcucgcuggcggcggugcugccgggggugc

SEQ ID NO: 4966 - RNA, 71 nt, Zea mays
gcggcggccguggggcccgaggaggcgcugcagcccgggcagcuguacuucgugcuccccgcggcgaugcg

SEQ ID NO: 4967 - RNA, 144 nt, Zea mays
ggacggccaugaccuucuugccguuguugcgcccgugcaucaugagcgaguuggugaggcgcucgacgauggcgcacugcgccuugcggaaccgcuucuuggaguagcgccccgcggagugcggcaggaaugucgcgugcuucg

SEQ ID NO: 4968 - RNA, 86 nt, Zea mays
uggcaccaguggugaggagguagauggccugguucacccuccucaggggugagauauccacggucugccugcucacaacaccagcg

SEQ ID NO: 4969 - RNA, 73 nt, Zea mays
uuuggaggguugggcggccgccauguggaugcggugcacaggcaaccaugagcugacugcugagcccauggca

SEQ ID NO: 4970 - RNA, 90 nt, Zea mays
augcaugcauuaggugauaggaguugugugaucaaacaguugaugcauuuccauccuugauuaaaaaacccuaauaccuguuuuaugaaa

SEQ ID NO: 4971 - RNA, 62 nt, Zea mays; identical to SEQ ID NO: 4885

SEQ ID NO: 4972 - RNA, 99 nt, Zea mays
auguccuuaaaccagacauacuugcuccuggcaaucucauaugggcugcaugggcgccuaauggaacagaugaaucaaauuaugcuggugaaggauuug

SEQ ID NO: 4973 - RNA, 230 nt, Zea mays
gugaagcguuuggaucgugauccauuaccaccucaccuuuggacguggacaggauaugaagcgaaguuuguuugaguuuucuaguugugugcagucugcuuccguuucagcauguauaaugacauggaaauuauuuggucagagaucaaaaaaaaaaaaaaaauggcggacgcgugggcuguccacguccaaaggcgaggugguuauggaucaccaaccauucacuugau

SEQ ID NO: 4974 - RNA, 118 nt, Zea mays
cgguuauucucaauacauauggauuggaugagauuggaaaaaauuaagaagaaguuugacuuguuugggauucaaaccuaucaaaucucacucaauucacguggauugagagcuaauc

SEQ ID NO: 4975 - RNA, 94 nt, Zea mays
auuggagugaauugaggugguauaagguauauugaaguguaauauaaacuaauuucccuuuaaaucccuaaaauacaucucaauccacuucaau

SEQ ID NO: 4976 - RNA, 93 nt, Zea mays
gcaccaggggcugucgcuuagccuuggcacgcagggggugccggugucucuuuaccaguaccgccaggcggaggcaggcauggccgccgccgc

SEQ ID NO: 4977 - RNA, 126 nt, Zea mays
gugaugucuacagcuuuggggucgucaugcuggaacucuugacaggccguaaaccauuugacaguucuaggccccggucagagcaaucacuuguccggugggcaacuccccagcugcaugacauug

SEQ ID NO: 4978 - RNA, 60 nt, Zea mays
aucaccaucucauuccucauaguuaguuaguuaguauuaauaugaggaauuggaucauuc

SEQ ID NO: 4979 - RNA, 143 nt, Zea mays
cucgucaacaaggccacugggcucgccaucaagcacucccucggccagucccacccgguaccuguuuguacuccugaucuucuauccaucggccaggacgagggagggcuugauuugauuucauuuugguuauuguauccauu

SEQ ID NO: 4980 - RNA, 260 nt, Zea mays
gaugcuucuuucgccacauaugcguuuuaguacacgcguuuuggauguauucauauuuguuuccuuuuuuuuacacgugagggugacagugacuccugagcaagagcaucccucccuuccuccuuguuccuauggagggagacuaaucgcaacuagccuaauggcucgaaguacgugcuuuuuguuugugcaggucaaccgugaagaaggaggugacacagacggugguggugaagccaggguggaggaaagggaagcag

SEQ ID NO: 4981 - RNA, 151 nt, Zea mays
uacaugggaguggauugaccgggaacaugaagcaaaacagagacccaagcuggaggggcacacaugggggaccgggccccacuucccccaccagaccagacgacgcccacuuuuuuuagcccaugucacucgcaguccgcaccgggcaguc

SEQ ID NO: 4982 - RNA, 62 nt, Zea mays
cucgucuucggcggcggcgacggcgguggcgaugcuguccggcgacguucccccgaaccaga

SEQ ID NO: 4983 - RNA, 69 nt, Zea mays
uuuaucuaaauuacuaaauauagaaacuaaaacucuauuuuaauuuucauauuuagcaauuuagggauu

SEQ ID NO: 4984 - RNA, 74 nt, Zea mays
uccucguucuuuuuuauuugucgcguuuuaguuuaaaaauaaacuagcggacgacaaauauucaagaauggagg

SEQ ID NO: 4985 - RNA, 103 nt, Zea mays
uuuggaucuuacuccuuccuuucuuucuuauuuguugccguuuaguucaaaaaugaacaagcaggcgacaaauauuugagaacggagguaguauguuacaaga

SEQ ID NO: 4986 - RNA, 151 nt, Zea mays
acuuguagacuaaacuccgaaggugcccuaugguacuuucuugcuucgucguucaugagcacaagguuauuuguucgaagcuuccucuuucuggaauguguauauugauaacuccgauugaaggccaccuucggcauuaguucugcuuuug

SEQ ID NO: 4987 - RNA, 123 nt, Zea mays
cacacacacaugccccacccguucauccuugugauggaacaaaaaaauguaagaugcggcauaaaacacacauguuauaaguuccauacuacaaugggcaaaacuggaggggcgcagagaaua

SEQ ID NO: 4988 - RNA, 83 nt, Zea mays
ugcccacaaaagcacacaacaaauuaccgggcacauagugaagucagguuuucugguaguguugucuguuucuaugggucuga

SEQ ID NO: 4989 - RNA, 69 nt, Zea mays
aggaauacaagggcaucuucuggcaggaggacaucauccccuucuuccagaacgugaccauucccaagg

SEQ ID NO: 4990 - RNA, 230 nt, Zea mays
gcaggagaaccacugggcucgagacuguccgaaucaaccgucggauccuuauccugacaagggugggagaccaguagcuccagcgggcucaccuggugcgugcuacaacuguggucgguccggccacuggucccgcgacugcccaaccucgaauagugguggugguggugguaccggcaccagccgugccaggucguccucagccuugagcucguggaauagucagagau

SEQ ID NO: 4991 - RNA, 93 nt, Zea mays
accugcacuggacgaucgaucgggcucgugcuuccagaucuggaagugaagcgaacccgcccggcagcccggcauccuccuccuccuccuccu

SEQ ID NO: 4992 - RNA, 149 nt, Zea mays
gaaaugcauuucuauauccuugaacuuguuaaaugauguaccacacaucccuaaacuuguaaaaauggugcaucacaggcccauuuuuggaccauagugaccacugcggugugcuacuuaacaaguucaaggaccuaaaaauguauuuu

SEQ ID NO: 4993 - RNA, 143 nt, Zea mays
gagagugauaucgagcgcccgccguguugugcgcgcguacguauguaugcgcucgugugaugcacgaauaagcguggcuacguaaucuaucguauguauacguguguguguaugcaugugcuuguguaugaucgugguacgag

SEQ ID NO: 4994 - RNA, 180 nt, Zea mays; identical to SEQ ID NO: 4848

SEQ ID NO: 4995 - RNA, 73 nt, Zea mays
ugguugugaacaugcuaaguuugcuguuuauuggaauccgccuugagcagcaauuuggauuuguucgcauugg

SEQ ID NO: 4996 - RNA, 181 nt, Zea mays
aguacguggagggauacccucgcgaggagcacauggagcugcuccagggcgccgagguuccccuccgccugacgggcgccgagccggccggguccguccucgucaggaaccucuaccucuccugcgaccccuacaugcggcccaagaugucgcgcccgcugcgggaguccuacacggccgc

SEQ ID NO: 4997 - RNA, 69 nt, Zea mays; identical to SEQ ID NO: 4895

SEQ ID NO: 4998 - RNA, 66 nt, Zea mays
auuagaccccuuccugcuucaguuggggauucuguaguuuccaccggugggaagacugcugauaug

SEQ ID NO: 4999 - RNA, 75 nt, Zea mays
guuaggggguguuugcuuagagagaauaaagauuagucucuaguuuuuagucuuuuuugccaaacacuaugacua

SEQ ID NO: 5000 - RNA, 74 nt, Zea mays
caccucccccgugccgggcuccucccacgcguuccacagguggaagcagaagcaguccggcacguccacccaca

SEQ ID NO: 5001 - RNA, 92 nt, Zea mays
ucuuggcauuuauccugcuguugucaccaagacugguuucugcuuuccggaacaccaugcuuuaggugguuagguagguaagcaaaaaggga

SEQ ID NO: 5002 - RNA, 370 nt, Zea mays
ccgccggcugaaggaggugguggagucgcuaagucagguggcugacuucaccaaccgcacggcgucgggggcccucacggcaguugugucugccgaagucgagagacuucggacacaacaugcugacgccguccgggagaagucggccgccgacagcaagugccgcaagcuggcggacaagguggccgcgcuggagggagagaaggcugaccuccggcgccaauuggcgggggagaggagggagaccaacgaggcccucgccaaggcgcaggcugcgcaggcggaggcuaaucuggcacgggcggagggcaaucuugccagggagcacgccgagcagcugcaggagcggcucaucgcccuggagagccgc

SEQ ID NO: 5003 - RNA, 346 nt, Zea mays
gcgagcuccggcaccuguggccaccaccgguggagggaagauccacgcgccagaugucugaucucguguuggcgcaugcgcaagcagucucccucgcaaauucccuagaaggcgagcgaugcguggaacucagcuccuacucgggcauccuugcggcaauggugaggggcgguuaugggggaggaguaguuuuauacccagagcugggauccgaucggcuagcgccgagcuggcacaugggaaagauuuguuccaaguuuguugcgaugaaacuggaauggauaucuacugagguggcgcuaggaucuccucuacggucggccauacgguugccauaccagaaggg

SEQ ID NO: 5004 - RNA, 84 nt, Zea mays
cgaggugcgcacaugugcuugggcacgagaugguccggcgcguugcugguuccugccguccgucccaggugauggaucagaggu

SEQ ID NO: 5005 - RNA, 90 nt, Zea mays
acuaguuaaaucaugucauuuauuacuaacugcagcaucugcaauuuguuaagugauuugguuaaguaggaaugaugugguuuucaauaa

SEQ ID NO: 5006 - RNA, 213 nt, Zea mays
cgacgaccaccagcggcggcgaugucuaccgggcuccgggcgaggagcagccgcguggccgagggcguuuggagccacggcaggggcagcgccgcgcgccuccacggcgaccaccagcggcggcggugucuaucgggcuccgggcgaggagcauccgcguggccgagggcgucuggagccacggcaggggcagcgccgcgugccucccuuuuu

SEQ ID NO: 5007 - RNA, 77 nt, Zea mays
aaucggcaucgaucucggcacgacguacucuugcgucggcgccuggcaguacgaccgugucuagaucaucgccaacg

SEQ ID NO: 5008 - RNA, 278 nt, Zea mays
auauccgucgucuaaccuaguacgcaauucuagcuaguaaccagcaggaucaaauauacuuccuuuuucuucauaaaaaaaaauauauagauucccauuacaagugcuagcuagugcgcaugcacuaacugguauagaauagauagauacaauauuauucucguuggugggcggagaugaaauauacuaucgaucacguuguauuugagaacguagagaauauguuaguacacaacgacuauauauagcuaggcagcaugcagguggccacguacuca

SEQ ID NO: 5009 - RNA, 110 nt, Zea mays
cauuuguggggcagacuuauacuaggaggcagcagagggagagcuggauccagacccggggcggugaagccagcagcucugcucuagcagauaagucuccaacagauaau

SEQ ID NO: 5010 - RNA, 99 nt, Zea mays
ugaucccaaaaccauagggauugagguggauuggaagggauuaaagaggauuuugacuuguaggggauuugaucccccucagucccuauagaucagcac

SEQ ID NO: 5011 - RNA, 83 nt, Zea mays
gugcuccuccccacgcggccacgccacgccucgcuguaaaccgacccuguugaggcuuggacgcacccgcguguccgcgccug

SEQ ID NO: 5012 - RNA, 260 nt, Zea mays; identical to SEQ ID NO: 4980

SEQ ID NO: 5013 - RNA, 215 nt, Zea mays
guccgucuuggccucgacguugccuucgguugaugcuuucgcuucucgacgucuggauugcggguggaggugggauuuuuugaaacaugaagucgaagcugccacauuaggagauguggcucgguaacgaugacaugaggugaaccuccuucuucgugguuuggauuguuuuggaggucgagcaaaaaacuggagguggguguuggaucaagaua

SEQ ID NO: 5014 - RNA, 69 nt, Zea mays
gcugcuccugcgucgucgucaaggacuacggugaagaaucugagggccuuaacauagugcaggaguaug

SEQ ID NO: 5015 - RNA, 161 nt, Zea mays
cggaaaacuuuaagggcuuguucguuuuggugauaauccacauguauugggugggauugagccgguuuaaauccauaacaagucaaaauacaucucaaucucacccaauacacuucaauacacauguaauaucaauaaccgaacaagcccuaauaguuuuu

SEQ ID NO: 5016 - RNA, 82 nt, Zea mays
uauuaauauaaucucgaucggucaucguccuccuaugucaaugucaaauaaaggucauguggucaucgauauuguuggauuu

SEQ ID NO: 5017 - RNA, 68 nt, Zea mays
gccgcgagacggccgcgccggccuacgucauacccgaggagccgccggccguggucgagcucgucggc

SEQ ID NO: 5018 - RNA, 107 nt, Zea mays
auccaaaccuuuuuaauaucgugcgaaaaaaagguuuuagucaaagauguuaugaauggaaauuuacccaaccuuucuuuucgcagagcuauuguaggggugaagcg

SEQ ID NO: 5019 - RNA, 124 nt, Zea mays
ccuccuccucccugccuccuccuccuccuccuucaagaaccugguccucgagcgcaagaucuccgacgcguucggcucgucugggcuugcuaggcagugcaggagcggggcggggaaggagagg

SEQ ID NO: 5020 - RNA, 68 nt, Zea mays; identical to SEQ ID NO: 5017

SEQ ID NO: 5021 - RNA, 76 nt, Zea mays
guguauaauagacauucuccauguauuguuucguuuucaugauguagcaguacguacaggauuuucuuucacaugc

SEQ ID NO: 5022 - RNA, 191 nt, Zea mays
aaucuucucauuguugcuauuguuguuguuuccuugccauuuccaaacaauaucuuucaaagaaggccuaagcucacgaucacaaaauugcuuauacuccauuguaucaccuccacuuuucuuaaacucaaccauaugaaaacuauuugucacuucaaauaucucaacaucaaucgcaagauguccuuuuc

SEQ ID NO: 5023 - RNA, 83 nt, Zea mays
gucagggaagcggauaaggccggcagcggccgcacggguaucgcacguugcuccagcugcaugaccuucaucgccgaccacga

SEQ ID NO: 5024 - RNA, 262 nt, Zea mays
acuacuaguaugcucugucgacuguuguucaaaggaagcuuccaauugucaauaaacauuuuggaucggaggaucaauugcaauggcucacauacucaccauguggugugucagcugguuuccuucuguuucguacuacacuaguaggaguugugccaguuugccgaugcauccgcaugugcaagucggcagguggaagcauccauauucucuucugaaaaaaaagaagaaaaaauaaucacgacuagaguacacgacuaag

SEQ ID NO: 5025 - RNA, 78 nt, Zea mays
cguuuucguucguacuggcuagugcggcgcgggggaucaacaucgcccccucgcucgcgcgguuaucgagcaguuagu

SEQ ID NO: 5026 - RNA, 229 nt, Zea mays
gucgaaccccuucucucuucuucgaugauggcaauucucuccauuaaaacuaguggaacccgacggucuccagcaaagcuucgauaguugggcuccacaacgcaacgccuaggguuucuugcacgagcagaugaagcggcagccaccacacccucgcagcggcgacgacucgccggccggcgagagaggaagcgacggaggguugaagaaggggaaggggagagggagg

SEQ ID NO: 5027 - RNA, 66 nt, Zea mays
ccggugccucugaaguggcguuucccucuaucuuaauggaaauggaaugugcuuuaaaaaagaaau

SEQ ID NO: 5028 - RNA, 100 nt, Zea mays
aggcaccguaaugugaucgagguguucgaugaaaugaggaaguugggccaguugccagacucagagaucauugccaccgcgaugaaugcuuauggcaagc

SEQ ID NO: 5029 - RNA, 100 nt, Zea mays
ggccguggcggacguggggacgggcauggacggcgcugcuauuggugacgaggguguugccgaagaaccagugcucguccagcagguccagcgccggggc

SEQ ID NO: 5030 - RNA, 307 nt, Zea mays
cagcagcucgagcaggucgagaaggagguggccggguuucgucuagaacaacaggcgcgggagauggaacacgacagucaugggcagaaccgcaaggaugaugcucaacaggaggcggaccaagucacagguucgugaccaguuuaucagcguuccagggaggagacaaaccagagauccgaggagaggcaguuucagcagguuccucugccgaggaugggauuucugagguucaaagguggggaacccaagauuuggcucaagaaauguguggauuacuuccaucucuaccauguuucugaaacag

SEQ ID NO: 5031 - RNA, 97 nt, Zea mays
uaauugguacucccuccguucuuuuuuaugugucguguuuuaguucaaaaauguacuaccgacgacaaauauucgagaacggauguaguacaacuuu

SEQ ID NO: 5032 - RNA, 69 nt, Zea mays
agauaaaucuccuggaccggauggguuuacuggcagauuuuauaagacuugcugguccauuauuaaaga

SEQ ID NO: 5033 - RNA, 209 nt, Zea mays
agaccccccggcggcuagcgagauggacggcggcgccggcgaggaggggaagcaggagcggcaccuggugcuggcccacaagcucuuccuucuaucccaccccuccguugaugaccucuccaaggucgcccuccgcgccgaaguccucgacaccgugaaauccgaugauauggcgacgcuguuugagucgcuggucgccgcgggugugc

SEQ ID NO: 5034 - RNA, 119 nt, Zea mays
cuacgagggagaggacuaccuugagguggaccuugacauccaccgguucagcuacauugcuaggaaggggcuggacucguucagggcacgccucaagaacggcauccucgaucuggggu

SEQ ID NO: 5035 - RNA, 74 nt, Zea mays; identical to SEQ ID NO: 4919

SEQ ID NO: 5036 - RNA, 198 nt, Zea mays
gccgagcucgugcgugucgucggagggcagccccgaggcgggggcaggcggcgccggcgcgcccaugauccuggcggggugcccccgcugcaugauguacgugaugcugucgcgggaggacccccggugccccaagugcuacagcaccgugcuccucgacuucaacgacgcccccgccgauccgcgccacgccggcgc

SEQ ID NO: 5037 - RNA, 87 nt, Zea mays
gaucccaagaggaucuauguggagaaauucacuugcaauucaauuuugaauaaaaggggauuccuccccauggaucccuuaggaucu

SEQ ID NO: 5038 - RNA, 71 nt, Zea mays
ccuucauccggguuggcguucucuugacuccgagacgauuggauucaggacggacaacaccauugaagcgg

SEQ ID NO: 5039 - RNA, 82 nt, Zea mays
ugggucgagacgacgaguggcuggccugguguacuauggcaauuggcacuguuaccaugguggccacugucgguuccaugug

SEQ ID NO: 5040 - RNA, 149 nt, Zea mays
aaauaucguggggauuacaugcggaggaagauaaagcggugcaaaggguucaggaucuagaaaccgacgagucuaaguuucuucacuuucuaaauccuaaauccuguggauguuuucaucuuccuccgcauauaagccucaugauaucc

SEQ ID NO: 5041 - RNA, 89 nt, Zea mays
caccgagguguugccguggucaccauuguuugaggacuuuguaaagguccucgccaucgacggaguugcaccauggcagccguucaguu

SEQ ID NO: 5042 - RNA, 77 nt, Zea mays
uaguuuuguguugcugaugauggugauaagugccggugggcucggccuucuuauaagucuaaguaacccuucuauac

SEQ ID NO: 5043 - RNA, 190 nt, Zea mays
uagggguuguuugaaugcacuagagcuaauagguaguuggcuaaaaauuugcuaguaggacuagcuagcuaacuauuaguuaauuugcuaaaaauagcuaauacuugaauuauuagcuauccuguuugaauguuuuuagcuaauuuuagcagcuaacuauuagcuuuagugugcauucaaacacucucua

SEQ ID NO: 5044 - RNA, 63 nt, Zea mays
gcccgcugcggucucucgcgaggguccccagaccgaucuucggcgagaguccaacauuucuua

SEQ ID NO: 5045 - RNA, 141 nt, Zea mays
cgcccuucguccgcgugccucuuaucggcugccaugaugcugcgcgcugugggcacgcgacuccuaugcguaugaggaggcuauccagcgcccauagucgcugcugcuguggcggcgagcaggagcagaggauaccacaag

SEQ ID NO: 5046 - RNA, 94 nt, Zea mays
aaggaaaaauuugccauuauggaugucuuccgaugcggcuuccacgauuuggaugcguaggcgagggauucucuauuauggaaaacuaaaggac

SEQ ID NO: 5047 - RNA, 464 nt, Zea mays
cacacacacacacacacacagacaagugguuuccaaagccaaguguguguacuagcaaccagcuagcucgggcggcagcaggcagccaucaugucggaggagaagcaccaccacuucuucaaccaccacaagaaggacgaggagcagcccgccggcgaguacggguacuccgagaccgagguggucaccgccaccggcgagggcgaguacgagagguacaagaaggaggagaaggagcacaagcacaagcagcaccucggcgaggccggcuacguauuccacgagcaccacgagaagaagaaggaccguaguaccggccggcgcgcgaccgagcuagcuagcuccggcgcacacaaccacacaccuguuuaauucuguacugcaugcguguguaauuugaugguucacaauaaugagucccucuccggaccuugguagcugcuugcuuguggugagugagagug

SEQ ID NO: 5048 - RNA, 67 nt, Zea mays
gggccuucauguuuccuccaccuucgccaaaauaucugcgaggggaggcagggaggcaggagucacc

SEQ ID NO: 5049 - RNA, 140 nt, Zea mays
agucccugaguacugucuuggguuagugagggggcgcaaagcacuggacaucugauguccacucaggccuuuugaggggguaccucaccugucuuaccaagaagugccccccaagcagccuuagacauacaaaaaaaaaa

SEQ ID NO: 5050 - RNA, 133 nt, Zea mays
agaacagugcccccucaaucuggcguagugcgcugcuuuguccuuguucuguguauaggagcuaguagagugaucugaugcaccguuuugucgcuacuguagccacuaaagccgacggaggggcgcgccacgg

SEQ ID NO: 5051 - RNA, 65 nt, Zea mays
gcgagagcggccucucgcucgcgcuggagggcacgcccgggcgagagggaggcgagacauuggcc

SEQ ID NO: 5052 - RNA, 90 nt, Zea mays
cggguucggcuucucccacgcgcguguuguuggaucaagcugagcauggcgucggucaggccgugcguguccgugaagcccgccgugcgc

SEQ ID NO: 5053 - RNA, 82 nt, Zea mays; identical to SEQ ID NO: 5039

SEQ ID NO: 5054 - RNA, 67 nt, Zea mays
gcaccggcgguaccacgaggagacgggcaucacguucgcgucgcucuacccggggugcaucgccacc

SEQ ID NO: 5055 - RNA, 118 nt, Zea mays
cgccugcagcggguccauccccgcggagcagcugcggcaggugaugguaagccacggcgaccgacucacggaggaggaggccgacgcgaugcuccgcgaggccgacccgcgcggcgag

SEQ ID NO: 5056 - RNA, 90 nt, Zea mays
uagaaucccuccguucuuuuuuauuugucgugguuuaguucaaaaaugaacuagcggacaauaaauauucgagaacggauguaguagaau

SEQ ID NO: 5057 - RNA, 116 nt, Zea mays
aauuuuuagucucuucguguuauucuauuuuagucccuaaauugcuaaauacggaaacuaaaccguauuuaacaauuuaagugcuaaaauagaauaagauggagggacuaaaaauu

SEQ ID NO: 5058 - RNA, 209 nt, Zea mays
agucggagguacgcgcguguggaacgcagggauggaggcgucgcgugagaugcaagcaagcacauguuccuuuuccccggagacggaggccacgcugcaggagcacgcgcgcaacggcggcauguggacgcgaaugaagccaggcaugagaugccccgaugcccggacgcggccucucauuguugugccagacgacgugauccgcccug

SEQ ID NO: 5059 - RNA, 179 nt, Zea mays
ucccgugacgccgaggcguacgcucuccugcucugcucugcucugcgccugaugaugagugcaaggaaauggagcgcuuugauucuucugcucuugguugcaucugcuaauugauuuagcaguggugguaagguacacgcacgacgagcugacugcgugguucuugguuugggccuuag

SEQ ID NO: 5060 - RNA, 71 nt, Zea mays; identical to SEQ ID NO: 4870

SEQ ID NO: 5061 - RNA, 98 nt, Zea mays
ugaacuuauagcucuugagaucucacgucagacgaaagcuccuauagaggagugccgcaagaaaaucuggcuuguugauucaaagggcuugauuguca

SEQ ID NO: 5062 - RNA, 111 nt, Zea mays
auccuuggggaccacaucaccacgguacaugaggcagcaggccauguacuugccauggcgugggucgcacuuggcccugaugacgacgguggugccuguggauucaagaac

SEQ ID NO: 5063 - RNA, 91 nt, Zea mays
aguccucguagccgucagacguaagcuuauuuccuagggccguuagagcaggccaucuaacauaagcuuauguccaacggcucaacccuga

SEQ ID NO: 5064 - RNA, 65 nt, Zea mays
cuccuggcaugccggcuggugcagucucucuguggggagcagcgucugguugucagccccagggc

SEQ ID NO: 5065 - RNA, 70 nt, Zea mays
acaaucucaggacucagguuauggggggcagagguuccucuuucuuuaggccuuguucggcagggguugc

SEQ ID NO: 5066 - RNA, 148 nt, Zea mays
aguaaagccugcgguaacgguauaguaccccgcgggaauugaaggaggaaaccaaaccgugcaucgcauauuagaaaggcaaugcaggucuuguuuccuucguuuuccccaugaagaaaccguacuagcuguagcugcugcaccguuu

SEQ ID NO: 5067 - RNA, 143 nt, Zea mays; identical to SEQ ID NO: 4979

SEQ ID NO: 5068 - RNA, 148 nt, Zea mays
aauaagguccaggcccgcgagucggcucgaucucggaguggucggcucggagcggaucgcaagccucgaacgagccgagccgagccaaccuuuuaggcucgucguaguagcgagccaagccgagccgguucgcgagcugugccaaauu

SEQ ID NO: 5069 - RNA, 125 nt, Zea mays
cgaucacguggaggguauggucgcacauacgcgcuacgaugugagcgugaugacugggcagugggcaacaugugucgcgugguccgugugcgucggggcguccgugugcccagcccuaccgucuu

SEQ ID NO: 5070 - RNA, 87 nt, Zea mays
aguauugacuccaauccacguguguugagauaaauuaaagugaguuuaaguuacaccucaacacauguggauugagaccaauacuag

SEQ ID NO: 5071 - RNA, 256 nt, Zea mays
aucgcuugaucgacuucaacggacugcgagacauuaacggcccucaagaccucaaacaagacagcagcugucugguacgccuuagugagcagugcucggucagccuuaucagcagcaugcugcagugccuggauguacuucuuguaguauucgcgguagaagcgcugcaucucccgagcaucgcucugguggacccuucccuugagcgugggaucauuuucccucucaagccucugcagaagugcggucuuaaacu

SEQ ID NO: 5072 - RNA, 132 nt, Zea mays
agaggaagaagggcaagagcgcuguagcuuagagcauucucauggauugucuugcaccgaaauguguguuccgaugaguacacuuuuuuugguuagucgucucaaguucagagcguuaugccauguuuucag

SEQ ID NO: 5073 - RNA, 87 nt, Zea mays
auuggaggggauugauauggauugagagagauuuuaauuuacuauggauugaaacuuccucaauucauauggauuggacuagaaccg

SEQ ID NO: 5074 - RNA, 208 nt, Zea mays
acgaaaaccgaccauucauuccuucuuccauggcgaggagggcgacggugauggugcucgcggcggcgcucgcgguccuccugcuggcgucgucgucgucgaagacggcccccguggccagcgccgcccgggacgaccccucggcagcggcggcggcggccgucacuucuucucgugaccugcagaaggauggaucggcggcggcggc

SEQ ID NO: 5075 - RNA, 99 nt, Zea mays
uggagaagggcggcugcaugcggugguugguguccaugcgccagauggagccccaggacucgcgcaucggcgcccaccgccccgucggcggcccgcgcg

SEQ ID NO: 5076 - RNA, 125 nt, Zea mays
auguaagccaccaggaagcaaugcaagcaaccgugugugcgugcgagugcaaacgauuuggacgugggggacaccucacguacgccuugcaacauguugcucugcguuuuuuuuuauguaaaagg

SEQ ID NO: 5077 - RNA, 93 nt, Zea mays
cuuguauucaucucaauccacauguguugaggcggauuggaguguaaauuaguuuaaguuccaccucaacacguggauuaagauagauaccag

SEQ ID NO: 5078 - RNA, 124 nt, Zea mays
cuaaacccacucaauccacuccaauccauauggaaucaugucuaaacggacaagcucuuaaacucuuagaucuuguucgguuauuuuaauuucauguggauuggaguguauuggaauggauugu

SEQ ID NO: 5079 - RNA, 76 nt, Zea mays
ccgccgccucgcgcugcggggccccgccgaccugcucccggcuuucgucggggccgcgcgcgcgccgggguccgac

SEQ ID NO: 5080 - RNA, 192 nt, Zea mays
cgaaucuugguuggaacaaucgcguauuacaucgggugaaucguccucucaagguuucuguacacccaaaaaaaggccauacgucccuacagugugugcgucauucauacccaucuguguggacagaaggaagccuguuauuggaauguccuuucauucuuguaaugacgcagaggaguucuacaaaucaua

SEQ ID NO: 5081 - RNA, 63 nt, Zea mays; identical to SEQ ID NO: 5044

SEQ ID NO: 5082 - RNA, 81 nt, Zea mays
cagggcaucggcaucgcgcucuccaccgucgccauggucaucucugccaucgucgaggaccggcgccgugccaucgcgcuc

SEQ ID NO: 5083 - RNA, 131 nt, Zea mays
agaggaagaagggcaagagcgcuguagcuuagagcauucucauggauugucuugcaccgaaauguguguccugaugaguacacuuuuuugguuagucgucucaaguucagagcguuaugccauauuuucag

SEQ ID NO: 5084 - RNA, 73 nt, Zea mays
ggacgucggacauaagcuuauguccaacggcugucgauaagccgucggacauaagcucuuauguccgacaacu

SEQ ID NO: 5085 - RNA, 67 nt, Zea mays
gggacgacaacgaggagcugagcugcaucucguucggguucagcaucggcuucgucgcguccagcug

SEQ ID NO: 5086 - RNA, 88 nt, Zea mays
ggaguggauugaggugguauaaaguguaucgaaguguaauaugaacuaauuuccuuuucaaucccuaaaauacacuucaauccacuuc

SEQ ID NO: 5087 - RNA, 241 nt, Zea mays
ggcacucggcaaagaggcuucuuugccgagugccgaauacugggcacucagcaaagaaggcuuugccgagugucuucuauagaaacucggcaaaccauauuuuuguuuuuuacauuuuggccaccaaacuuuuuguggccauaacacucggcaaagaaucaagaccugggcaccgguauagguucuuugccgaguguaauggcucuggcacucggcaaagaagcacgcuuugccgaguucc

SEQ ID NO: 5088 - RNA, 93 nt, Zea mays; identical to SEQ ID NO: 4859

SEQ ID NO: 5089 - RNA, 384 nt, Zea mays
ggaagcgccugcgccgcgagcauccuuccugagcgcggggccaagcagagcagugcaagcagcauauggcgcgccgugccagccugcuccucgccgcggcgcugcucgucgccgucgcugccgcggcggugccgccgacgugcgagcgcaucgagugcccggcguacgaggugguggacagcgccaacggguucgagauccggcgguacacggacgccauguggaucaccacggcgcccaucgaggacaucuccuucgucgccgccacgcgcaccggcuuccuccagcuguucgacuacauccagggcaagaacgcguacaaccagacgaucgagaugacggcgccggugcugacgcgggugucgcccagcgacgggcccuucu

SEQ ID NO: 5090 - RNA, 87 nt, Zea mays
auacaccugaucccaaugugcgcucccgcgucgucaucguggaccucuucauccugacugccgaggugcauuugcgaucgggagaga

SEQ ID NO: 5091 - RNA, 210 nt, Zea mays
cgagacccccggcggcuagcgagauggacggcggcgccggcgaggaggggaagcaggagcggcaccuggugcuggcccacaagcucuuccuucuaucccaccccuccguugaugaccucuccaaggucgcccuccgcgccgaaguccucgacaccgugaaauccgaugauauggcgacgcuguuugagucgcuggucgccgggggugugc

SEQ ID NO: 5092 - RNA, 72 nt, Zea mays
aacgguccuuugccgagagccaucuuugccgaguguuugccucucggcaaagcgcucuuugccgaguacuuc

SEQ ID NO: 5093 - RNA, 74 nt, Zea mays; identical to SEQ ID NO: 4919

SEQ ID NO: 5094 - RNA, 100 nt, Zea mays
cucuggcggauucuuugccuagugcugucaggcagacacucggcaaagguaacuacuuugucgagugucgcuugggacacucggcaaagacuccgucucc

SEQ ID NO: 5095 - RNA, 92 nt, Zea mays
ugguaaugguaacgauucacacucgaauaccggcauuaaacaaauuugaauaagacuauccauuuguagugugguaucgauuacaguuaaac

SEQ ID NO: 5096 - RNA, 185 nt, Zea mays
accccgcagcagccacuuaucaggaguuccucaguacccagccaccguuguuuaccagggcagaggacccacuugaugcugaugcagccuucagggggcaucauauaccagcaggcaucauggaccgcaagcucaaugaguuucuggcacucacucaggggaaccggauaguguugcaguaugcu

SEQ ID NO: 5097 - RNA, 296 nt, Zea mays
aucguucaucgaucucggcacgacguacucuuagugauagaguguguggcauugcgaccguguacugauuauugccaacgaccaguguaaccguaccacuacccucuuacguggccuucaccgacugcgagcgccuaauuggagaugcaggcacgaaccaaugaacacaugaaccuuauaaacuccguguuugcugccaagggucuaaugccgaggagggacagggaugccacuggacauagugauaugaaggugcggcccuucaagguacuucugugcugcuguugagagcccau

SEQ ID NO: 5098 - RNA, 66 nt, Zea mays
cgccgcgcgccucccugucuccuccccggcgccugccgcggcuggagcaggaggcggcgugccguu

SEQ ID NO: 5099 - RNA, 165 nt, Zea mays
cgcccgcuucgcggcgcuggacguggaccgcgacggccgccucucguacgccgagauggccggggagcucauggcgcugcgcgugcgggaggcgcacuucggggccgacggggcgcucuucgcgcgcuucgaccgcgacggggacggcgccguggaccgcgacga

SEQ ID NO: 5100 - RNA, 66 nt, Zea mays
ccucaguaaugcauguggcugcgcguugggugguccaacaagcagacucgcagugcauaacucuga

SEQ ID NO: 5101 - RNA, 123 nt, Zea mays
  misc_feature (58)..(58): n is a, c, g, or u
  misc_feature (86)..(86): n is a, c, g, or u
ucgcugcuccuugugaaccggcuccucuacggcaagcugcccccggggccgcggcggnggcccguggugggcaaccuguucgacgngcagcccgugcggugccggugcuaccaggagugggcg

SEQ ID NO: 5102 - RNA, 100 nt, Zea mays
gugccaauggucacccagugccccauccugccgggccacaacuucaccuaccgguucgacguggccgggcaggaagggacgcugugguggcacgcgcacg

SEQ ID NO: 5103 - RNA, 213 nt, Zea mays
gcagcuaauuauuagcucuagugcauucaaacagggucuaaguauagacucuagaaaaaaaaggaacauauuucuauccuggguuuacacugcuuauuaugugccauguguauuguuguaccugugccuucucaugacuccuuaccaaaggauuugagguguuaacucagauuccauucauauugagaccauuuugugcuuauagguugcuga

SEQ ID NO: 5104 - RNA, 111 nt, Zea mays
gauaccuucccucuaugcuugaucacccagagccaucucgaggaucuguaaaggaaaggguuccacccucccaaauugaucucugguuggcgguuggaggaagaaggcggu

SEQ ID NO: 5105 - RNA, 73 nt, Zea mays
gcggccaaagggcagccccuggcgcuauugccuucuucggcggcaugacgaaggugguugcucgagcuguugc

SEQ ID NO: 5106 - RNA, 238 nt, Zea mays
cgccgagacuugcgaugcucgaucaacaugaaguuguucauuacuguggcggugccgccgcggcgccggcgcuagcgcuggcgaccaagcggccgacggagggcgucccuggcuugggcaaggugcccaacaugcucuacgccucugccaucacccuugacaucgugcugguacacaaaucgagacaagucauacaugguaguguagacucgguggcggcgcacguuaggucucaggc

SEQ ID NO: 5107 - RNA, 77 nt, Zea mays; identical to SEQ ID NO: 4951

SEQ ID NO: 5108 - RNA, 69 nt, Zea mays; identical to SEQ ID NO: 4840

SEQ ID NO: 5109 - RNA, 69 nt, Zea mays
gaggucccuuggcuucggcuucgucaccuucuccacggaggaggcgaugcggaacgccaucgagugcau

SEQ ID NO: 5110 - RNA, 89 nt, Zea mays
aucgacuaaucgagcuaaucgacgacuaaucgcgauuagucaccuuaucggugcuuaggcgacuagagucgacuagccgacuuuaaaac

SEQ ID NO: 5111 - RNA, 169 nt, Zea mays
agaguccccaguugagaggaucccaguggucuaugacuacccagauguuuuuccggaugaauugccagggaugccacccgauagggacauagaguucgcaauugaauuacaacccagaacugcacccauaucuaagagaccauauaggaugccuccagcagaauuagca

SEQ ID NO: 5112 - RNA, 67 nt, Zea mays
gaguacuccuuccacgggcggcccagguacacguggugcacgccgggccucucgcgguacagcgcca

SEQ ID NO: 5113 - RNA, 70 nt, Zea mays
accagcuucaguucagcaucaagacgcuccuucucauaaggacgccuugguuucuugaacgucuuaccau

SEQ ID NO: 5114 - RNA, 71 nt, Zea mays
uaguauacgaucugcugcagcuauaccggccaauaguauggcaugguauggcugcaggcagccgcacaccu

SEQ ID NO: 5115 - RNA, 235 nt, Zea mays
uuccugcagaacuggagcugccacuaaugucauuuuugggcuugcucuggguuacaaaucagucauuaucccaauuuuugcuauugcguuuaguaucuuccuuagcuucagccuugcugccauguaugguguuguuguggcugcucuuggaaugcugaguaccauugccacaggccuugcuauugaugccuauggcccuaucagugauaaugcuggaagcuuaagucuguauggg

SEQ ID NO: 5116 - RNA, 178 nt, Zea mays
gacgcuagcgccggcggguacgccuccuucgccgacgguggcgucgaggagguggacgaggagaucaccguagaguccuacggcgucccgauccgccacgucuccgggggauacucgccauucucccccgaccucgagcccaacggcagcgacggcccgacccugccgccgcccaccg

SEQ ID NO: 5117 - RNA, 109 nt, Zea mays
cacccgcaccucgggguugcccgugauguugcgcacaagcugguacgagcagaugcccagggccacggccaucggcacgaacagcggguacaccucgggacggauccac

SEQ ID NO: 5118 - RNA, 154 nt, Zea mays
gccaccucccgcuccguccggcagcccgccgcguccagugcgccaccgacgccgccgcccuuuccccggcggucaccaccaagcaccggcgcgcggcggaugagaacauccgcgaggaggcggcgcggcacccggccccgaagcagggccuguc

SEQ ID NO: 5119 - RNA, 76 nt, Zea mays
gcuacucuugaggcauacgagguugagauggacgucuacauguuugaucuuucugcccugguugugaacaaggcuu

SEQ ID NO: 5120 - RNA, 148 nt, Zea mays
acaucccucucaccaggagcacacuugucuacugugauaacaucaacaccguuuaccuuuccauaaaccucauguagcauuagcgcaugaagcauguugagaucgaucuuuacuuuguccguaaguguguugcuguugggaaguaugu

SEQ ID NO: 5121 - RNA, 149 nt, Zea mays
gggcagcguggcuggcacuugggcaggccggccacgcgaauccgauccguggcgaggcaaaccgcgugcucaugugcggcccagcacgcccggucggucaggcgggugaccgccgccaaaccugcucaguugccagccguacacgcuug

SEQ ID NO: 5122 - RNA, 181 nt, Zea mays
aauauacuauuaggugagugccugugcguuacaagccugaguuucucuuggauaucauucuggauggcuugcggauguugucauucaucucauaaucguauaacacauauuuguauauauaaguuaucaagauauuauauguuccagauguaaugcacggacacugaccuaucuuauauaa

SEQ ID NO: 5123 - RNA, 72 nt, Zea mays
uacgaagcuugagcuugggcuaucugcaaugacgaaagaccaacuugcagacagccuugcuuauaacagcuu

SEQ ID NO: 5124 - RNA, 127 nt, Zea mays
ucccccuguuugacgauggacagcguggugcagccgcucuggaccgcauccaagcgacggcugcggcgggagcuugccaggucgaacuggcagucgccaagcuucuucucgucgucgaugagcgacg

SEQ ID NO: 5125 - RNA, 58 nt, Zea mays
uaaauuaucaaauauagaaacuaaaacuuuauuuuaguuuccauauuuaauaauuuag

SEQ ID NO: 5126 - RNA, 74 nt, Zea mays
gggggguaaggggggggggggggggggaauuugccaggggcgaagggcccguuccuuuggcuuuuuucccuccu

SEQ ID NO: 5127 - RNA, 115 nt, Zea mays
uccucauuuuuacccuuagucguguuuuuuuuucuaaaguuuugcucuuccaguguucuauagagcagaaggguaaaacugaugaaaaaaauaugacuaaggguaaaaaugagga

SEQ ID NO: 5128 - RNA, 148 nt, Zea mays
cuuuauuuaugcaugcagcuguugguugagcucauacuaagauuuuuucauuaauuaugauguacgguguagguauuuaugcaacauucuauaacaauuuaugcuuugugcgauauuaguuauccaacuuuugcauguauguugugug

SEQ ID NO: 5129 - RNA, 69 nt, Zea mays
acaagucacgcgacgguugucggguguucaguguuaugcucaaaccgggaaucgucgucaugcguauaa

SEQ ID NO: 5130 - RNA, 429 nt, Zea mays
uccaccaccuccugccaccgcgcggccccaaccaaccacuccucgucagcaccuaccucugcaacaaccuccucgccuacuacgccagcgugggcgugagucgugguugcuuccgcgaggcgcggugccuguucgacgacauaccguacgcgcggcggaacgcguucacguggaacucgcugcugucguuguacgccaaguccggccgccucccugacgcccacgucguguucgccgaaaugcccgaccgggacgccguguccuggaccaucaugaucgucgggcucaaccgcuccggccgauucugggacgcugugaagacauuccuggacauggucagugaaggguuugcgccgucgcaguucacacucacgaacgugcuuucaucgugcgcugcgauggaggccugcgggguugggagaaaggucc

SEQ ID NO: 5131 - RNA, 475 nt, Zea mays
gucaaaguaccagugagcauggagguuugguuaggcuugguuacgacgacgucgaguuggcggcggagaucuucccaccgccgcuggcaauggcugccccgcacgacgaggccgcggcgugggcggaggaggcggcgcgccgggucugggccggcgccgugccgcuccagguccaccuccacgacgccgacgucaccgcgcuacccccgccgccgcccuuccugguaugcauggucgcuuagcuguuaauuaagaccacagcugcucaauuucuagggugcuacagccuacagcagcgcacauuaccuaccggccgcccgugggagauucaguugcuggcuugcugcuguaggauuugccugucuuuuguggcugauacccaacuacggguccaauuaauauuuugaaguugaauaucauugggucgucaugacuccugagccaauuucucggggcuuacaagguccuuucugcu

SEQ ID NO: 5132 - RNA, 169 nt, Zea mays
gucaccgucgaccgcgucggccgccgcaagcuguuccuccagggcggcgcgcagaugaucgugugccagcucaucgugggcacgcucaucgccgccaaguucgggaccagcggcacgggggacaucgccaagggcuacgccgcggucgucguggucuucaucugcgccu

SEQ ID NO: 5133 - RNA, 100 nt, Zea mays
cuuuggcgcgaacgggggacgcgggggcggcgucgggcgugcuuuggcgagcucagagcgcgucgaacacguggcucuuugcuucuguucuuguucuacc

SEQ ID NO: 5134 - RNA, 84 nt, Zea mays
auguggagucugggcugcauguuugcugggaugauuuuucguaaggaaccauuuuucuacgggcaugacaaccaugaucaacuu

SEQ ID NO: 5135 - RNA, 102 nt, Zea mays
caucuguccguuuguucccuugcugccgguaauguguauccucauaaauacauacuuguuaauaaaucuugguggcggcacguggaugcaagugggggugug

SEQ ID NO: 5136 - RNA, 68 nt, Zea mays
aguauucuguuagauccaacgguucauugguuuugucgcuuggacauggauuuggugguuucaggcuc

SEQ ID NO: 5137 - RNA, 114 nt, Zea mays
gggggggggggggggggaauugauguagucgugcucuaaauggcacggcucuuacuacaugucgaccgagacucggugaugaugcuuucuucucuccuaccuuuacgcuuugga

SEQ ID NO: 5138 - RNA, 239 nt, Zea mays
ccagagcgccugucgaucuugguaaugagcucagcaaacuugacagcgaugugggagguguggcaguccaacuccaaggaugacccugccaaggaggcugccagcuucaccucccaggucaucaucaugaaccacgcugggcugauuggcaacgaggugucccccucugcuucgacugccacacgucccccuuguucuuguggucgccggcgcucguuuccagguugaccggcgcucug

SEQ ID NO: 5139 - RNA, 68 nt, Zea mays
uccguucuuuuuuauuugucgcgguuuaguucaaaaaugaauuagcgggcgacaaauauuugagaacg

SEQ ID NO: 5140 - RNA, 168 nt, Zea mays
aggaggcgcucgacacggugcgccgccugcucggauggggcucgccugcguucgccgagaggauccgggccggcacuacuccccucgacgaucucgcugccggggaguuugugcucuucgucuccuaucucuucugcggguuggcgcugccgauuucgcuguucuucc

SEQ ID NO: 5141 - RNA, 169 nt, Zea mays
cauggaccgacagcaggccuugcgagcagcagcaaaguucccaggaugucaagucgcauaaggaagcccaauguccguguagcaggcccagaauggaggauguaaugugugguguguguggugagguugggaacuuaagucgcgcugcaggcgugguguaauaaucuga

SEQ ID NO: 5142 - RNA, 217 nt, Zea mays
aaccauugguugcucuggguacucaguggcguagaagacgugccacuucuguccaggucuugcuggaucuccaaucacauaagcauuaccaccagauuucaggccgccaaaguagcgguuaagugcagcaacuuccucagaaaagcuccugggggggcuggcugugcgccaggaaagaugaacgucccacgggaguacuucacagcagcagguggca

SEQ ID NO: 5143 - RNA, 111 nt, Zea mays
uugauggucguuugccgagagccgcaauucgccgaguguuuggcccucggcaaagaagccuuugccgaguguauuccugugccgagaguucugcucucggcaaacgucaug

SEQ ID NO: 5144 - RNA, 63 nt, Zea mays
cuacaucguuuagagacgucuuggguggucugccgaucccaagacaaacucuaggaucucucc

SEQ ID NO: 5145 - RNA, 260 nt, Zea mays
aucauauuuuggcauuggcauccuuggagagaacuguagcccgucugaggagugguuuacuguggcugaaagagggugacgccaauaccucauauuuucaucaacacgccagguauaagaagagaaaaaacuucauugggaaguugaaggucggggacagauuauuguucgagcaggaagauaaaaaagaggcagugugggauuucuauaaucaucuucuugggacaguucauugcagggacucuacucuaaaucuagau

SEQ ID NO: 5146 - RNA, 154 nt, Zea mays
gagcucauuguaggcaaauugugcgauugaucacuuuuucuuuacucaauaauguuccuguuaaucauuaugauuugcauagguuaauuuugaugggacccaauaggucacccuaguuuggucaucucuacaccuuguuugccauugaacuugu

SEQ ID NO: 5147 - RNA, 306 nt, Zea mays
cgacucacgcccggcgaacucuagccgcggccacgggucaucacacauggucuccuggcggcgcagcgcguccuggcugucgucggcgucgcgcuccucgcucggcgccgccgucggcggggaggccaaggucacgccggaggcggauccggcggcgcagcacgacgaggccgacgaggagcgcuggucgcgccugcugccggagcugcucacggagaucaugcggcgcgucgacgccggcgccgagcgcuggccgccgcgccgggacgucguggucugcgccugcgugugccgccgguggcgcga

SEQ ID NO: 5148 - RNA, 135 nt, Zea mays
ucauugguuaagggcuaguuugggaaccccauuuccucaaaggauuucuauuuuuaaggaaaauuaguucauuuucccuugaaaaauaggaauccuugagaaaaugguguugccaaacuagccuuaagcggggcu

SEQ ID NO: 5149 - RNA, 258 nt, Zea mays
uuagcgucuccggcucuugagugaucuccaaguccuuuggaaugcuacagggaagugaagugaugggggagugcgaggacggcaaggaguacaggugcugggaggagcugcugccggacgcgcugggccucaucuuccgcaaccugccgcugcaggaggugcucaccguccugccgcgggugugcaaguccugggggcgggugguggcccgccccuacuggcuggcaggagaucgacaucgaggaguggagccagcag

SEQ ID NO: 5150 - RNA, 97 nt, Zea mays
uucguagcgaugcacaaaucagaaucuccaucguccucacaaacaucgauuggguuuguuuauggaccgagagauggugaucgugcacgugauaugg

SEQ ID NO: 5151 - RNA, 154 nt, Zea mays; identical to SEQ ID NO: 5118

SEQ ID NO: 5152 - RNA, 85 nt, Zea mays
agugccacagacauuacacucggcaaagaaccuaaaccggugccuaggucuugguucuuugccgagugcuauggucuuuacucuc

SEQ ID NO: 5153 - RNA, 102 nt, Zea mays
cucaauccauguggauugggugggauugaguggguuuuaaucccaaauaagucaaaaucuuugauaauuuuuuccaaucucauccaauucacaugggauagg

SEQ ID NO: 5154 - RNA, 88 nt, Zea mays
uggcagugggcccgcauggucagucgcggcggagcacagugagaagacugggcuugggucgugcggcugacaaggcggucccgccugu

SEQ ID NO: 5155 - RNA, 73 nt, Zea mays
cccuccccgugugcuacgcgugcgugugugagagugauaucgagcgcccgccguguugugcgcgcguacguau

SEQ ID NO: 5156 - RNA, 124 nt, Zea mays
uccaccaccuccugccaccgcgcggccccaaccaaccacaccgcagcgcagcaauggcgggcaacggcgccaucguggagagcgacccgcugaacuggggcgcggcggcggcggagcuggccgg

SEQ ID NO: 5157 - RNA, 281 nt, Zea mays
ucagcggcacggcagggccaugaaugggagcaguacgaaauucaaggcuggauccguagaucagucuaaacacacggaccaccaugucaguggcaagugaucaggcacacgugccuggacuggaccaucagccccaccacugcacggucucguacgagacauuugcguuuaugacacucccaauaagcugcuucgcuggaauggcacucuaaagcaccuucucgccaaaaugagacugccaccguguguugcuugauguuuuggaccugucggcguuuaua

SEQ ID NO: 5158 - RNA, 100 nt, Zea mays
auaagcuagaaagaacuauauuuuagaacggaagaagugucauauuauguaaaaaagaauauaugaaaaucguacugauauguugggcuugcagcuuagc

SEQ ID NO: 5159 - RNA, 68 nt, Zea mays
aggucccgcggcuucagcuucgucaccuucuccacggaggaggcgaugcggaacgccaucgagggcau

SEQ ID NO: 5160 - RNA, 206 nt, Zea mays
ucagcagcuagcgcgcuccucgagcccagcagagaaaggccggcagcgcuaaucguaauagccaugggcuccaccgccggcgacguggccgcggugguggacggggaggcgugcauguacgcgaugcagcuggcgucgucguccauccugcccaugacgcugaagaacgccaucgagcugggccugcuggaggugcugcagaagga

SEQ ID NO: 5161 - RNA, 81 nt, Zea mays
gacaucgaggucggcaggaagguccuaccggugcgccugcuggaggacgucagccggugggacuucgucgaccuccccauc

SEQ ID NO: 5162 - RNA, 67 nt, Zea mays
acguccgcauguccaucgccgacguccugcaugccagcauggaggacgagcggauggcggccaggga

SEQ ID NO: 5163 - RNA, 68 nt, Zea mays
aggucccgcggcuucugcuucgucaccuucuccacggaggaggcgaugcggaacgccaucgagggcau

SEQ ID NO: 5164 - RNA, 74 nt, Zea mays
uuugaccuuguuccaugagaggagaccagccgucgcuugggccggucacuccucucacggugcuuugaaggugc

SEQ ID NO: 5165 - RNA, 81 nt, Zea mays; identical to SEQ ID NO: 5161

SEQ ID NO: 5166 - RNA, 246 nt, Zea mays
guccacgccuacaucaaggcuuuuuucagccgugaaucuuuugucaagacuaagccauccgaggagcacgugauugcaggaugggcgcccaaggugaacgcguaaucacaucgugauuuggugcuaacugguggacuccauccauuugucugaucagucauugucagugguguguguaggugucacaccuguagccuagacacaugauucaguuggaauaaaugcagugucgugugaucgugucuc

SEQ ID NO: 5167 - RNA, 206 nt, Zea mays
cuucucugaucgcgauucguuucugagcuucgaggaaucgacagucaagcuucggcgaccaagagaucaaacucuucgaguucuacaaggcugaagauccugagcaucuguuuggugaagguugccuuuggugcaaucuaugcucagguaaagaaggugccgaggcagaucuccaggaguuccaggacuucgacgaguucgaggau

SEQ ID NO: 5168 - RNA, 59 nt, Zea mays
gggagcccuuccagaaauucucaguggcccagugggccaaagaggggguuuggaaauag

SEQ ID NO: 5169 - RNA, 355 nt, Zea mays
gcggcgcgaagcgucaccggaaggugcugcgcgacaacauccaggggaucacgaagccggcgauccggaggcuggcgaggagggguggcgugaagcgcaucuccgggcugaucuacgaggagacccgcggcgugcucaagaucuuucucgagaaugucauccgcgacgcugugaccuacacggagcacgcccgucgcaaaaccgucaccgcuauggacgucguguacgcccucaaacgccagggccgcacucucuauggcuucggcggcuagguuagguguggguaauugccuguccaggugucucggaucugugguacuaguuuggcugccuuccuguguucguauuguaguag

SEQ ID NO: 5170 - RNA, 72 nt, Zea mays
gagcuggggugcgugggcaggcgacguggcuggggaucucggcgugcgugcgcugguccacggugguucaca

SEQ ID NO: 5171 - RNA, 68 nt, Zea mays
agaugcuguggauuaucuuacuuggacguucauguaucggcggcuagcuaagaauccuaacuucuaca

SEQ ID NO: 5172 - RNA, 124 nt, Zea mays
cugaacauccagaaggaguacggcaagcuccucaaggacuucaacaagggccuggugaacaacaaggacaucgagaaccucaagguccagguggagaaguuugccgacuccuucgacaugccug

SEQ ID NO: 5173 - RNA, 81 nt, Zea mays; identical to SEQ ID NO: 5161

SEQ ID NO: 5174 - RNA, 126 nt, Zea mays
uucaauugauccggcaugagcugcucugcaugaggucguccguuguuuuucugggagugaaccggugcugcauaauugcacuucuaacgagcgcuacauggagcaucugaugucggacgacacaga

SEQ ID NO: 5175 - RNA, 104 nt, Zea mays
guuguacuuuauuuucagaaggcugcuucggcaggacaaaguacuuucuuugacguuuuaaaauauguugcugcccagucaccuucucagaaaucaaggcaacg

SEQ ID NO: 5176 - RNA, 229 nt, Zea mays
caucacccagucgcuugugguccucgucgucgcuugcuucgagcucgccuggcacaucgacgcgucgagaugugaagccuucguugcacagacguugcccuaccucguggcccuggcacucaccucugacuccagcaccaagucgauccuucacugccucuucacgauccgcaacguguuaucacugcacgacuacgacgacgaccagagcuacaacgacgauggcgga

SEQ ID NO: 5177 - RNA, 209 nt, Zea mays
ucguggaaggugucggucgaugucggagcaggggagacguggggggugauaggguugugccaggggaguguguugcgcugguggucggguugugcugagggccgaugguggccggagcgaggcggcaaagugguggagacuaggcgcuguggcagggacacgucgcgacguagaugcgguggcggcgucgauguggcacgacgaugggg

SEQ ID NO: 5178 - RNA, 206 nt, Zea mays
ucagcagcuagcgcgcuccucgagcccagcagagaaaggccggcagcgcuaaucguaauagccaugggcuccaccgccggcgacguggccgcggugguggacgaggaggcgugcauguacgcgaugcagcuggcgucgucguccauccugcccaugacgcugaagaacgccaucgagcugggccugcuggaggugcugcauaagga

SEQ ID NO: 5179 - RNA, 163 nt, Zea mays
gcaagcucaaccacgacgacagcgacgacgacgacgacaagaacgaagacgaguacaugcugcuugccgaggcccgacagccgcuguggcgcaagguuccgaucccgucgagcaugaucaacccguaccgcaucgucaucgugcuccgccugguggugcucug

SEQ ID NO: 5180 - RNA, 66 nt, Zea mays
cuguucccccgccugccucggugccaccuucggaagguugcgccggcggugcgugaccuuugcaag

SEQ ID NO: 5181 - RNA, 115 nt, Zea mays
guuuguuugagauuauaaucuauccagauuauauaaucuaacaacuuuugaacuaagaguuaguucaaaaauuguuggauuauauaaucuagguggauuauaaucucaaacaaac

SEQ ID NO: 5182 - RNA, 73 nt, Zea mays; identical to SEQ ID NO: 5155

SEQ ID NO: 5183 - RNA, 124 nt, Zea mays
ccucccaccuccugccaccgcgcggccccaaccaaccacaccgcagcgcagcaauggcgggcaacggcgccaucguggagagcgacccgcugaacuggggcgcggcggcggcggagcuggccgg

SEQ ID NO: 5184 - RNA, 150 nt, Zea mays
gugcgugcguggcuggcacuugggcaggccggccacgcgaauccgauccguggcguggcaaaccgcgugcucaugugcggcccagcacgcccggucggucagacgggugaccgccgccaaaccugcucaguugccagccguacacgcuug

SEQ ID NO: 5185 - RNA, 207 nt, Zea mays
ucagcagcuagcgcgcuccucgagcccagcagagaaaggccggcagcgcuaaucguaauagccaugggcuccaccgcucggcgacguggccgcggugguggacgaggaggcgugcauguacgcgaugcagcuggcgucgucguccauccugcccaugacgcugaagaacgccaucgagcugggccugcuggaggugcugcagaagga

SEQ ID NO: 5186 - RNA, 441 nt, Zea mays
gaccgcacaugagguugguccucaggucgucgugacugcgccugggcagaccgucccuucggugcccugcgcgcccgaggcggggauggugccgaagcuggcagcggggcaaaccuuagcggcgccugcgggggccgaggcccgaggggccuccccgcaggcacgauuggccuugguccggaguugcaagcggaggcacggccagaccggucuggcucccuggaagguucucaagacggcgccagcuucugcagccagugucgcaccuggccacaccagccggcuggccuccucacaagaugccccaaagcgggggggcucagucggcacgaguugucguggggcgagcucccgaggcugaccccuccaucgaggcagacgucgugccgagggagacugcuggcgcgggcacggccuugagcccgccugacguguugccga

SEQ ID NO: 5187 - RNA, 106 nt, Zea mays
ggaaaaguuuggagaucccuuguuccagaggcauguugcagcugcaagcaugugggggcuuguugcucuuaggcucucagaugaggagauccuacccuucaacuac

SEQ ID NO: 5188 - RNA, 77 nt, Zea mays
aucgucuaauugaauuggcuuugauuuugccuguugcaacugcaacuguagaaagagcauuuucagccaugaaaauc

SEQ ID NO: 5189 - RNA, 79 nt, Zea mays
ccccgcggaugacugacccaugggcgucgccuuuaauuagcacuguugggucaugcgcagggguaccucaaucgcggua

SEQ ID NO: 5190 - RNA, 160 nt, Zea mays
gauggcacacauguaaaggugacugucccaacuaaguugaaggggagauauaggucaagaaaaggagaaauugugacaaauguguuggguguuugugcaccugacaugcaguuuauauaugucuuaccugguugggaggguucugcacaugacgggcgug

SEQ ID NO: 5191 - RNA, 124 nt, Zea mays; identical to SEQ ID NO: 5172

SEQ ID NO: 5192 - RNA, 64 nt, Zea mays
ccacucgacagauucgucuuugccgagugcuauggcuccagcacucggcaaagcuggcaucuag

SEQ ID NO: 5193 - RNA, 72 nt, Zea mays
cauacaaagcacucgacaaaguaccugacauggagaccccgcuggcggauucuuugccgagugcuguccggc

SEQ ID NO: 5194 - RNA, 90 nt, Zea mays
uuugguggcccaggcccggcagcccguggucaaaaucgaggguuccacccuccgcgucggccagguggccgccgucgcuuccgccaagga

SEQ ID NO: 5195 - RNA, 108 nt, Zea mays
ggacaagggcggagguauuggcgcgccucaauccgaaggcguggcugauagauuggcgcggcagccauguucuuggauugagccgcgucaauaucuccccuugccugu

SEQ ID NO: 5196 - RNA, 90 nt, Zea mays
gauccgagauuuguugagagagcauccuugauuacagggauagcaacaaacuaaaucuucaaggaugcaguccaccacaaaucucgguua

SEQ ID NO: 5197 - RNA, 68 nt, Zea mays
uuuuaacuuuguguugccuuguuuuuuuauuccauauagcaauugaaaacaagugaccaacaggguau

SEQ ID NO: 5198 - RNA, 242 nt, Zea mays
gcagcuagcgcgcuccucgagcccagcagagaaaggccggccuacccagucugugucugugugugugcaguguccaccggcagcgcuaaucguaauagccaugggguccaccgccggcuacguggccgcggugguggacgaggaggcgugcauguacgcgaugcagguggcgucgucguccauccugggcaugacgcugaauaacgccaucgagcugggcgugguggagguggugcagaaug

SEQ ID NO: 5199 - RNA, 130 nt, Zea mays
auuuucgaaggauaugggugacauugaccgaaaugucgcuguauuugucaauauguuuauggcacaaauaucucaguugcucucaacuuucguucucaucggcuuugucagcaccaugucucuuugggcu

SEQ ID NO: 5200 - RNA, 82 nt, Zea mays
gcccaugccagaaccagugccgccacccagggaguggcauacuuggaacccuuggaggcagucgcaguucucggccuccuug

SEQ ID NO: 5201 - RNA, 219 nt, Zea mays
agaauguuucaccaucuaccguaaagcccaaggaagugcuuauccugaaagcaauggaugaagagccaaagaagcagaaucgggucacauggaccauugagcuccaugaaaaaguuuuuggaggcuaucgaaucucuugggggaaacaaguccucgugaaaccuggaguuugaacacauggcuguucccauggcuuuuguagaugaaguggagcagcgc

SEQ ID NO: 5202 - RNA, 60 nt, Zea mays
auaguaaaauagggcauuuccgacggccaaagccgucggagauaagcucuaagccgucag

SEQ ID NO: 5203 - RNA, 235 nt, Zea mays
  misc_feature (106)..(106): n is a, c, g, or u
  misc_feature (121)..(121): n is a, c, g, or u
  misc_feature (136)..(136): n is a, c, g, or u
  misc_feature (165)..(165): n is a, c, g, or u
  misc_feature (209)..(209): n is a, c, g, or u
uccgggcuccgcugcuaggcuaggguuuggacuuuggauuggagccgcaccgccgcaccggcaccgcagucgccgcagugccgcacagccaccacucccaucuugnucuugcggcuagucngccucggaaccucgncaucgaccccuugccgcuugccgagacgncgaguaagcgucgaacgucgucgcugucgucaccgaaguccaanggcccaacagccggguuucaagcuuc

SEQ ID NO: 5204 - RNA, 93 nt, Zea mays
cggugcaauuugcauucucucucgcuguacauacuguaccguucauaagauauccggaacgaauggcgagaggagaggcaauguaugcuggag

SEQ ID NO: 5205 - RNA, 71 nt, Zea mays
cgaucaggugaucugaucgucuauaucguccgacuagucggcgauauguagcgauuagucgucugguuagu

SEQ ID NO: 5206 - RNA, 114 nt, Zea mays
  misc_feature (47)..(47): n is a, c, g, or u
  misc_feature (62)..(62): n is a, c, g, or u
auaacugcaugugagacuaguguggcucguagucuguagagugcgancgcugcacuauauunauaucacugcacuguaucgcugcggcgcccacgagaguacacaagagauuau

SEQ ID NO: 5207 - RNA, 79 nt, Zea mays
gcaaaagguguuuuugugaccauacggguggacuacuguacauugcaccuauauggucacuacaaacacuguuuugcau

SEQ ID NO: 5208 - RNA, 68 nt, Zea mays; identical to SEQ ID NO: 5136

SEQ ID NO: 5209 - RNA, 164 nt, Zea mays
gggguauuucugcauucccuugcacuuauuuggggcugccucuauccuugcauaagcuguccaagcaucaguuccaaccaauuguugagaagauugcugaucagcuccccaauuggaaggcagaucucaugacucgagcugggaggagagugcagguucagcau

SEQ ID NO: 5210 - RNA, 59 nt, Zea mays
aggagcccuuccagaaauucucaguggcccagugggccaaagaggggguuuggaaauag

SEQ ID NO: 5211 - RNA, 104 nt, Zea mays
guuguccuuuauuuucagaaggcugcuucggcaggacaaaguacuuucuuugacguuuuaaaauauguugcugcccagucaccuucucagaaauccaggcaacg

SEQ ID NO: 5212 - RNA, 163 nt, Zea mays; identical to SEQ ID NO: 5179

SEQ ID NO: 5213 - RNA, 262 nt, Zea mays
caaggucauaaaggagcuguuuggagcuguugccuugacaggaaugcucugagggcugcaucugcuucugcugacuuuucagcuaaaguaugggaugcacuuacuggggaugagcuacauucauuugaacacaagcauauaguucgggcgugugccuucucugaggauacacaccuuuuacucacuggaggcauggaaaagauuuugcguguguaugauaugaaucguccugaugcagcuccaagagagcuugacaaaucac

SEQ ID NO: 5214 - RNA, 101 nt, Zea mays
uggguagcccaugcgccuagucacgacucguucagguugauugauuuauaguuuauaauacauaugcuuugauugaugucgggcagugcauguauauauau

SEQ ID NO: 5215 - RNA, 141 nt, Zea mays
gagagugauaucgagcgcccgccguguugugcgcgcguacguauguaugcgcucgugugaugcacgaauaagcguggcuacguaaucuaucguauguauacguguguguguaugcaugugcuuguguaugaucgugguacg

SEQ ID NO: 5216 - RNA, 79 nt, Zea mays
gguggaccuucgccaugagcggucagucaguggauggagugccgcuucccugaucucugcacguuggcgagugaugagu

SEQ ID NO: 5217 - RNA, 67 nt, Zea mays
gcaaugauguuugagugaccuguuuugacgacccggcgucgaaacgguguaucuugaagagcggcaa

SEQ ID NO: 5218 - RNA, 69 nt, Zea mays; identical to SEQ ID NO: 5129

SEQ ID NO: 5219 - RNA, 71 nt, Zea mays
ucguccugaaggacggcuuggugcucauggaggaugauuuccgggagcgccuggccgugcccaagaaaacc

SEQ ID NO: 5220 - RNA, 161 nt, Zea mays
ugauguugccggacccagcgaggggguggcggcgaucuccaaaggggggaagguagggccgaaccggugcagcgccugcaggaagaggguuggacuuacgggauucaacugccggugugggaacuuguacugcgcacuccaccgcuacuccgacaagcacg

SEQ ID NO: 5221 - RNA, 163 nt, Zea mays
aauuugggcgaaacuguuaaggccagacuucaacaauucucugugaugaacaaguucaagaagcaugcacuuagggucauagcugagcaucuuucaguagaagaggcugcugacauaaaggauauguuugagaagauggaucuuaacaaggaucaaaugcuua

SEQ ID NO: 5222 - RNA, 82 nt, Zea mays; identical to SEQ ID NO: 5200

SEQ ID NO: 5223 - RNA, 124 nt, Zea mays; identical to SEQ ID NO: 5183

SEQ ID NO: 5224 - RNA, 83 nt, Zea mays
ugucagugcgacagauagagccuuccacuauguugauguuaguuacaacgaugucguggcugcuuacaaucuucuugacagca

SEQ ID NO: 5225 - RNA, 58 nt, Zea mays
caaggcccgauucccuuuuuuugucacggggggggggggggggggaauaaaggggggg

SEQ ID NO: 5226 - RNA, 319 nt, Zea mays
cggcggagagucggagucgggcccguccuuugacaucugcgacgacggcggcucccaccuguccggcaugcgagacacgaaggaggaggaggaggagaagggugagccagaggacgucauggagcaggcagcucacggagucacuggagaucuggcucccaucugcaacgaugacgaguccaaaucgcaccuguccccgcugcaagagucguaccacgacaucuacgauggcagagucgggucagagccguggccguccuucgacaucugugaugacggcggagagucggagucgggcccguccuuugacaucugcgac

SEQ ID NO: 5227 - RNA, 109 nt, Zea mays
uauagaaaucgauuucuacaugcgguuccuuaagaaaaucgucuguagaaaucauggauuucuacaugcguuuucuuaacgaaccuccuauagaaauuugauuccuacu

SEQ ID NO: 5228 - RNA, 70 nt, Zea mays
uauauagaaggagauugaauccccuccuauacaaauuuauauagaaggagauuaaaucuccuucaaccca

SEQ ID NO: 5229 - RNA, 134 nt, Zea mays
aacaauacuuagggcuaguuugggaaccccauuuuccuaaaaaaauuucauuuuuacaagggaaaaugagcuaauuucccuuugaaaaaagaaaaucccuugaacgggguuuaaaacuagcccuaaauggcuga

SEQ ID NO: 5230 - RNA, 104 nt, Zea mays
gucugccgcgugcggacgucgccguugcgguaggccuccaccagaacggacgccacggucuggucggccgccaccuccagcgcgauguccucgacgcgcaggau

SEQ ID NO: 5231 - RNA, 122 nt, Zea mays
uauagcaggucuuagggcuuguuuggaaacuuaaauccccuccgggauuuccagggcuaauuuuccccucaauccucaggagucccggaggggauguaaguuuccaaacuagcccuuagaag

SEQ ID NO: 5232 - RNA, 161 nt, Zea mays
uagcuaaguuucguaggcaucuccaguuuuuguuucgucuauuaguagggauggauucggaucggauacucauggaaacagauccgaacgucacuauuuaccauauuuuaauccgaauacgaauacuaucggauacgaauacaaaacggauaguucgaauu

SEQ ID NO: 5233 - RNA, 99 nt, Zea mays
accgguaaagcuuauuugccgaguguuguggcacuggcacucggcaaagaagcaagcuuugccgacuuccuccaagagcacucggcaaagaugcugaca

SEQ ID NO: 5234 - RNA, 135 nt, Zea mays
uggccacagaguggacaugcaugugauaccgaggcuauauauacugaccguguacaguauacugaagaaaagucaaucuugauaccuucccuagaaaauuaauuuuugguauuuuuuauguuuccuuuucuguuu

SEQ ID NO: 5235 - RNA, 106 nt, Zea mays
gcuuugaauacugaauagugggacucacgagaagcauacaauauuccauuauggaacaccuccccuccuugcuugucaguagucccuguauucgguuuuucuccuu

SEQ ID NO: 5236 - RNA, 71 nt, Zea mays
gauaucgucugcuccgacgagacuggggcgcccaucacgggugcugcgcucucgucguugcacaagauccu

SEQ ID NO: 5237 - RNA, 71 nt, Zea mays
ucguccugcgggacggcuuggugcucauggaggaugauuuccgggagcgccugaccgugcccaagaaaacc

SEQ ID NO: 5238 - RNA, 71 nt, Zea mays; identical to SEQ ID NO: 5237

SEQ ID NO: 5239 - RNA, 68 nt, Zea mays
agaacaagaucgccaugcacuucgacagggucuuuuggcccaacgucgaggugcugggaauggucggg

SEQ ID NO: 5240 - RNA, 69 nt, Zea mays
gaagacacaaggauggcagggauguacagcuucccagcuuuccaugcccucgccucgcuacuguccgcg

SEQ ID NO: 5241 - RNA, 88 nt, Zea mays
  misc_feature (4)..(4): n is a, c, g, or u
aacnauugggaagacucucguguccaggacacaggguaccaggauugccucugauggucugaagcacagagucuuugaggguugucua

SEQ ID NO: 5242 - RNA, 112 nt, Zea mays
uuauuccaauuccauguggauuggaguguauuggaauggauuaggauagauuuuuauuugcuauggauuuaaaucgacucaauaccacccaaucuacauggauuaaugguga

SEQ ID NO: 5243 - RNA, 197 nt, Zea mays
cgcgcgcagcugcagcccggggucgggguggagggcgggcgcgugggcaagcccgcgcggcggcggucgcgcgcgucccgccgcgcgcccgucacgcugcucaacaccgacaccuccaacuuccgcgccauggugcagcaguucaccggcgucccgcccgggcccuacggccccggccccggcggcggcggggggcc

SEQ ID NO: 5244 - RNA, 60 nt, Zea mays
auucauuaccucaucaaaauuauggcacuaacauuuaggccauauuucgaaggagaauag

SEQ ID NO: 5245 - RNA, 67 nt, Zea mays
uaacagcaaggagaucgucgcagagagauugcaugaucgucugcgagauuguccaggugcugagcau

SEQ ID NO: 5246 - RNA, 242 nt, Zea mays
uuuccgacauggacaucuuagagaagauuggucucuugcagcaguuuguuaagccucaucacuuggauauacccaagguccugcauaacgaggcaucguggcugaaaguugcugguuuuaaucauguaaaauccaaaaauuuuaaauuauccaaaguucccaugaaagaaaucguuccagugauacagccaaagcucauacugacugagaccauucuuucucugcacaugccacuucagcuu

SEQ ID NO: 5247 - RNA, 163 nt, Zea mays; identical to SEQ ID NO: 5221

SEQ ID NO: 5248 - RNA, 124 nt, Zea mays; identical to SEQ ID NO: 5156

SEQ ID NO: 5249 - RNA, 70 nt, Zea mays
aacaagucgugcgaugguugucggguguucgguguuaugcucaaaccgggaaucgucgucaugcguauaa

SEQ ID NO: 5250 - RNA, 155 nt, Zea mays
uuucugcauaucccugugaugagcauuuuaguaaucugagagugcucacggucacuuggugcucccuccucaucgcucacgaugggagagguugaaggaaccaaugucucugcacuacauugcugagauguggcauucugagggauaucacccgu

SEQ ID NO: 5251 - RNA, 134 nt, Zea mays
acccccccccggggggggggggggggggggaaaaaaaauaaauaaaaccacaacggcccccccuuugguguuuuuuccccccccgccgggggggggggagaauuauucccccccccccccccccgggggggggg

SEQ ID NO: 5252 - RNA, 68 nt, Zea mays
cucguugaccucggcgaacacgugacugaccgcacucugguucucaacgugauucgcuagcucaacga

SEQ ID NO: 5253 - RNA, 70 nt, Zea mays
cucagcaaagaggccuccuuugccgagcgucugcuaucauggcacucggcaaagaaggcucuaaugggac

SEQ ID NO: 5254 - RNA, 78 nt, Zea mays
caguuagcugcuaaaauuaguugaacgcagcuaauaguuugguuauuggcuacuuuuagcagauuagguggcuaauuc

SEQ ID NO: 5255 - RNA, 64 nt, Zea mays
gcagccuucagccggcggugauuauuaggacugccuuggugauuuagcuggcuauauauacacg

SEQ ID NO: 5256 - RNA, 64 nt, Zea mays
cuuuguguagcugcccugccaccgccugcgaugcgcaugccauggcagguagcguugucuaaga

SEQ ID NO: 5257 - RNA, 634 nt, Zea mays
gcauggccacgccaaaugccacuuugucgccauagacauauucaaugggaaaaagcuugaagauauuguuccuucaucacacaacugugauguaaguuaauuucuguguuaagcuaaguucuuuugaugguucacuucauacgccacucacaaguuugacauuuuuuuagauuccgcaugugaaccguacugaguaucagcugauugauauaucagaggauggauuuguauguuccucuaaucauuaaaacuacauucuucuuugaaauaaauguuaacuucagucuuauauuuuaauuuaauuuguuucaggugagccuucuuacuucagauggcaacacuaaggaugaucuuagacucccaacugaugagacucuuguggcccagauuaaggaaggguucgaaagcgggaaggaucuuguugugacuguccagucugcgaugggggaggagcagaucugcgcgcugaaggauguuggccccaaguaacuuccuuggcuuuggagacggaacccuacucuaucucaacuuaaaucggaaaagaaguguaucaccaaaggauugcuaccgagacauucaccuggcuugagcuggcuuuugcuauagcgugcaagggguugcugggugucguacc

SEQ ID NO: 5258 - RNA, 73 nt, Zea mays
uucguuuuuuacagauuggagguccgacacgguuucugacuggauuguuucucuaauuuauguaaguuuugau

SEQ ID NO: 5259 - RNA, 82 nt, Zea mays
gaccgccgccgucaccucgcuccguucguggcucgggaucuucggcgggucguugcggaagcuuuggugcacguaguugaag

SEQ ID NO: 5260 - RNA, 79 nt, Zea mays
auuuuagucucuaaauuacuaaauacggaaacuaaaacuauuuuuuaguuucuauauuuaacaauuuagggauuaaguu

SEQ ID NO: 5261 - RNA, 69 nt, Zea mays
ugguaagacguucacgcaaccaaggcguccuuaugagaaggagcgucuugaugcugaacugaagcuggu

SEQ ID NO: 5262 - RNA, 92 nt, Zea mays
gccgccgucgccgccgccgucgccuucguaccgagauggcgcgccggcgcugcaaggaagaaugaagaaacggcggcggcuguaugccucgc

SEQ ID NO: 5263 - RNA, 146 nt, Zea mays
gauaucauauuaagggcuuguucgguuagggggggauugaaaaguauuggaggaaauuaaaaccccuuuuuuaaaauagaaggaaaauuaaucaccuucaauucccuucgauacagacacaaccaaacaagcccuaauaggguugg

SEQ ID NO: 5264 - RNA, 154 nt, Zea mays
gccaccucccgcuccguccggcagcccgccgcguccagugcgccaccgacgccgccgcccuuuccccggcggucaccaccaagcaccggcgcgcggcggaugagaacauccgcgaggaggcggcgcggcacccggccccgaagcagggccuggu

SEQ ID NO: 5265 - RNA, 66 nt, Zea mays
  misc_feature (4)..(4): n is a, c, g, or u
  misc_feature (59)..(59): n is a, c, g, or u
gcuncgcccggggggggggggggggggaauuuuuuuuuuccucuuuuuuucuuuuuuuncuugccc

SEQ ID NO: 5266 - RNA, 73 nt, Zea mays; identical to SEQ ID NO: 5155

SEQ ID NO: 5267 - RNA, 138 nt, Zea mays
aaaucuagagggagggggaggcggccggggaggugacccaaggaaaaaaacugguacgccuacaccaucggcgcaucagcuacgccggccgggaaccacccguuccgcgcccguccucgacccucccaccuauucgcu

SEQ ID NO: 5268 - RNA, 138 nt, Zea mays
cacuaaggcccuguucgguuuucacggauuggagcuccggaaugaauccuagccggauuacuuucucuauuuauauaaauuuugaugagcuggaacgaaucaugguccauucccggacaagcgaacaggcccuaacug

SEQ ID NO: 5269 - RNA, 244 nt, Zea mays
gguauugcugggcuuuaccguggauuuaacaucuccuguguugggaucauuguuuaucguggucuguacuucgggcucuacgauuccaucaagccaguuguccuuacuggcagccuccaggacaauuucuuugccaguuuugcucuggguuggcugaucacuaauggugcuggucuugcaucuuaccccauugauacgguccgcagaaggaugaugaugacaucuggugaggcugucaaguaca

SEQ ID NO: 5270 - RNA, 106 nt, Zea mays
  misc_feature (2)..(6): n is a, c, g, or u
  misc_feature (8)..(9): n is a, c, g, or u
  misc_feature (35)..(35): n is a, c, g, or u
  misc_feature (39)..(39): n is a, c, g, or u
  misc_feature (45)..(45): n is a, c, g, or u
  misc_feature (47)..(47): n is a, c, g, or u
  misc_feature (51)..(52): n is a, c, g, or u
  misc_feature (56)..(56): n is a, c, g, or u
annnnnunnggggggggggggggggggaaugaggnauanuauucncnaucnnaaunaauuuccaaaagaaggguauauuuuuuuuuuuuuugccccaaaaagaggg

SEQ ID NO: 5271 - RNA, 68 nt, Zea mays
aggucccgcggcuucggcuucgucaccuucuccacggaggaggcgaugcggaacgccaucgagggcau

SEQ ID NO: 5272 - RNA, 161 nt, Zea mays; identical to SEQ ID NO: 5220

SEQ ID NO: 5273 - RNA, 144 nt, Zea mays
cgcgggacgccaccggagcugacugccgcugcuggggccuggccguucucucauggucauggagacgccuucgcaggugauugcccccuccucgucgucacacucccuagcugcuaaggggucacgugguggugugcugcccga

SEQ ID NO: 5274 - RNA, 152 nt, Zea mays
ucauggacuuugacgucaucucggcgccggaggugacgcagaggaggaccgacagcaaugaucaguucgucaucaugucgcgcgcguucgacgacuacuauaucauggacuguggcgucaucucggcgucagaggugacacagaggaggacc

SEQ ID NO: 5275 - RNA, 206 nt, Zea mays
ucagcagcuagcgcgcuccucgagcccagcagagaaaggccggcagcgcuaaucguaauagccaugggcuccaccgccggcgacguggccgcggugguggacgaggaggcgugcauguacgcgaugcagcuggcgucgucguccauccugcccaugacgcugaagaacgccaucgagcugggccugcuggaggugcugcagaagga

SEQ ID NO: 5276 - RNA, 271 nt, Zea mays
accauccagcauaacuacacgucaaauaacuggguaccucgacgugaggagauuaaggccaagauaaucagugaaauucacucugaggcagaaaagaaucuuggauuacgcccuggagcagcaucugucauuaggaauggccguagcucaccaggagggccccuuucaccuggagggggauuuccaaugaaucggucaggaacuggaggcaugaugucugggaugccugguucaaggaagaugccuggaaugccuggguuggacaguagau

SEQ ID NO: 5277 - RNA, 67 nt, Zea mays; identical to SEQ ID NO: 5217

SEQ ID NO: 5278 - RNA, 124 nt, Zea mays; identical to SEQ ID NO: 5183

SEQ ID NO: 5279 - RNA, 95 nt, Zea mays
cugcuugccugcuuccugcgcugugucgcugcccggugcccgcugcuugccuugcccggccggccggcccccugugcagcguggcuccaaucgcu

SEQ ID NO: 5280 - RNA, 269 nt, Zea mays
cacucguccuccacaucacccgccccacucguccuccaucucauaugucccuaccgcgcgaggggcgccuccccuucccagaucccccaacggcguccucugccuugcccuccuucgugucccgcaugccgguuaagugggagccgccgucgucgcagaugcuggaguauagccccaacaacgaggacaugugggagccagaucugagggguggcggcgguaggggcgagaggcgggcgcgcgcuggagcaggugcuggggaacguggc

SEQ ID NO: 5281 - RNA, 146 nt, Zea mays
guuuaguuaggaggcacauagagauacgugacaaagucaccuuggcugaucagagcggcacaucaagcauuuguuggauguguuuuuuuuuuugaaaaaccuuacauuguagugucaucaucuuuauuuuugcuucucugcuuaug

SEQ ID NO: 5282 - RNA, 67 nt, Zea mays
aggccuuucuaaaccucugauacuaauauuuagcagcuaaaauuaguugagagguuuagaacagguc

SEQ ID NO: 5283 - RNA, 104 nt, Zea mays; identical to SEQ ID NO: 5211

SEQ ID NO: 5284 - RNA, 123 nt, Zea mays
gcggaaccuugguuguugccugggaccugggacugggagucugggaggaggaggaggacgucggccgccuggagcuaggguugcugggaccugggacugggaucagggacagccgaacaggga

SEQ ID NO: 5285 - RNA, 256 nt, Zea mays
gagaaauacuggcuucucuacagggcguugcaguggcuggcuacauuugcaggugacagaccuggguuugcucuaaaacuaggacuuuucaagcuauaucuguggaauggcuucuuuuccuuuguauuaugugccagcuucgaacagcagucagcugauccucgacucauuucuugacucguaggccaggauuauugaggauuaacugcuaugguguuuagacuucuuagggcuaguuugggagccaaaggauaau

SEQ ID NO: 5286 - RNA, 112 nt, Zea mays
acaguccccgucgcgaugccgucaauccgcgcuggcuaucagugucgcgucucgugcucugccuaugcgacgaaaugcuagccgguggacagcacaugcgacucaccgauuc

SEQ ID NO: 5287 - RNA, 90 nt, Zea mays
aaauuagagcagauugaagaggcuaaaaucucuuuauuauucauuuguuaacagcaacagaauuuuagaccuuuucaauccauuccuucu

SEQ ID NO: 5288 - RNA, 66 nt, Zea mays
uaaggguuuguucgguuagcauucaauccauauagauugagugugauuggaugaguuugaauccua

SEQ ID NO: 5289 - RNA, 110 nt, Zea mays
uugugcaaaagggggacgaagcaggggcgaacugauaccacccuugucuagaaauguggcucuacuacggcgugcauguuugcugaugcccucaacucucuuaauguugc

SEQ ID NO: 5290 - RNA, 63 nt, Zea mays
uuccugaggucggaguucagcugaccagggaaccuuaggcagcaggugacuccacucaugguu

SEQ ID NO: 5291 - RNA, 163 nt, Zea mays
uugauucauuugggccauuagaugcgagcugaacgauccacguuagaccucuguucauaaccuuugaccaucgauccaaaucugauggccugguucgcucacccccacagaucuugugcgcccacggucguguagcccaucauguggccggacucuaucaaug

SEQ ID NO: 5292 - RNA, 113 nt, Zea mays
uacucuaguauucccccuaauucacauguguugagauauauugggguguaaauuaguuuaauuuauacucuaauaaaccucaacacacguggauugcggugaauacuagagua

SEQ ID NO: 5293 - RNA, 86 nt, Zea mays
aggcguaacggaauucgugauuguugugcuggccaccgcaggauccgguuguccuccgcacaauaaugaugguccucgccucaguu

SEQ ID NO: 5294 - RNA, 319 nt, Zea mays
guaugcauugacucugucuaagcuccuguuugguggccugcacaagagagacgcaagcugcaugagcggaugcaaaacaaguuauuuuauagucauuugauugcauccacucguacgcaaaaauugcaguaucagauugaucuugagccuacgcguccggauacaggcauccaaucaggcacauacuaaauaacaagagaaaaguuuauccacuauuguuucucaugugucucuuuauguuugugaucucgcgggaaugcgaauccacggauuccuauuccuugaaccuagacagagcgaagacggagucggacccacu

SEQ ID NO: 5295 - RNA, 67 nt, Zea mays
uuuauacaaucgguuauuacuguagauauagaggaccaaauuuagaguacguugcugaagaugaaaa

SEQ ID NO: 5296 - RNA, 69 nt, Zea mays
gcaggaaggcgugccuggacgacugcgccugcgcggcggcgcaguucgucuacggcaccgacgccggcg

SEQ ID NO: 5297 - RNA, 82 nt, Zea mays
uacccaggucagaaugcucacuugacaguacggugcaugaaugcccuguaccgucugcaagugaugcguggugaggcgaugu

SEQ ID NO: 5298 - RNA, 64 nt, Zea mays
gcaaaggaauguggggcuacugaggagacagacgaguucuucguagcuucccaacuguuugcaa

SEQ ID NO: 5299 - RNA, 267 nt, Zea mays
gugaaguuuguucuaucggccauuccgacuuaucuuauugcaaucaaugucccucaguggguuauuaaaucaauugauaaaauucggcgaggauuucuuuggagaggaagaaaggagguuaauggugguagcugucuuguuccaugggaaguugucacgaggccccugaaauuuggugggcuugggaucccuaaccuuaaguucaaaagcugggcauugcaggcaaaaugguuaugguuggaaaagacggaucugagcagaccuugg

SEQ ID NO: 5300 - RNA, 112 nt, Zea mays
gcagcccccgucgcaaugccgucaauccgcgcuagcuaucggugucgugccucgugcucuaccuacgggacgaaaugcuagccgguggacagcacaugcgacucaccgaucu

SEQ ID NO: 5301 - RNA, 199 nt, Zea mays
caucucggccucgcgggcgccagcuccagcuccgucaggcccgggagcacggccaccccggaggcccggagccccgacgccacccccauacuucucgggcgcgucgucgcggugccucagcggcgccgaugagguggacaaugaggaggcgcugcagugggucaugauggagcgacuaccguccuucgagcgccugcgc

SEQ ID NO: 5302 - RNA, 104 nt, Zea mays
ggcaucgggcuccgguagcacaggucaguugcugaugccucgucuuccuccucugggguagaucgggcacggcgacugcgugcuccguugagggacggugcugg

SEQ ID NO: 5303 - RNA, 203 nt, Zea mays
acgauccggcggaagcggcugcuccugcgccucgccgggcccgacgcgaccgacgugcagcgcgagguggagaucacgcggcgcaugucggaggugagcgggggcagggucgcgugccugcgcgaggcgugcgaggacgacgacggugugcaccucgucauggagcucugcgagggcggcgagcucuucgaccgcaucuucga

SEQ ID NO: 5304 - RNA, 73 nt, Zea mays
cugccugcccacggcaugcucaggggcgcuggggucccuugccgcugucccugaagucuagccuggguuguug

SEQ ID NO: 5305 - RNA, 181 nt, Zea mays
cgcgggcgacuggucgaggcgguugcuggagugggacaugaccagcaccgggcgcgacgacgacggcgacggcgacggcgacccggccggcgacugguccagccgcuucccggagaaggacaugacgaggccugggcgcuuggcaacccgcggcggcgacuggucgggccgcuccccguag

SEQ ID NO: 5306 - RNA, 93 nt, Zea mays
agccaucgcaugcguguaggugcucuugcauggaguucuucuuugcuuucuucuggaagccgugacaagagcauccuccaccaugauauccgu

SEQ ID NO: 5307 - RNA, 75 nt, Zea mays
uuuaugugcucuuuuuucggaaagcucagcugauuucuuucugucgguuggucucggguuaggagguacagaaac

SEQ ID NO: 5308 - RNA, 89 nt, Zea mays
cgucaucaucauuggcgccgagauaacacacaucgacgccaguaccauuggcgccacuauguguuaccucggcgccaaugauaacggcg

SEQ ID NO: 5309 - RNA, 83 nt, Zea mays
acagucagccgcggggacagauauggcaguuggcgugaucgaaggcggauuaacggcuaugacucguccaagcgucgggcgac

SEQ ID NO: 5310 - RNA, 70 nt, Zea mays
agcgcagcaacuccuacggcuccggcuccuccgacuugguggggucguggucgugggacgacgacgagga

SEQ ID NO: 5311 - RNA, 146 nt, Zea mays
cucggcgccaucaucaauggcgccgagguugaucuauggcgccgacccccuaggacuugccacaucgucugccacguagaaaaaguaggcgccaauuaugucggcgccacugugcguuaccucggcgccaaugaugauggcgcaag

SEQ ID NO: 5312 - RNA, 123 nt, Zea mays
cuggggcacgcguacagccgcccaacaguaaugaggcacuccuggcaguugaagugguugggccgcuggaaugggccaggcaaaccucgccccagcugucugggccgcugaugguuccugggc

SEQ ID NO: 5313 - RNA, 61 nt, Zea mays
guggcagcgccgagaagagcacgguggggaggcuggugcgcuucaucggggagaagguuug

SEQ ID NO: 5314 - RNA, 74 nt, Zea mays
cagugaaucccgacaccaagguccugcaggcaaugcagcucaugacagguaacuugguugcccguguucuucug

SEQ ID NO: 5315 - RNA, 148 nt, Zea mays
aguagaucacaccuccaaugguugauggacaagcuagaccccaaggauaugacaauacguccugguccaggaaaggaacucaagaucacaaaggauauuguucaucuuauucuuggcgugccaaaucauggaggugguaaaccuuugg

SEQ ID NO: 5316 - RNA, 175 nt, Zea mays
cagggagcugaggcgugggccugcguguggcagcacauggugcagaacgaccucgugcagugcacggcuggggccuggaccucaacuucuggagagucugggguucgaaccugggaucuuccgguuacagacaguaggcucuaccgcugcaccaggcccgcccuucauaauacag

SEQ ID NO: 5317 - RNA, 163 nt, Zea mays
caaggagcucgacggccguaacaucaccguuaaccaggcccagucccguggcggaggcggcgguggcuacagcggcggucgcggcggcggcggcgguuaugguggcgggcgccgugacggcgguuauggcggcgguggcggcuacggcggucggcgcgaggcu

SEQ ID NO: 5318 - RNA, 166 nt, Zea mays
caaggagcucgacggccguaacaucaccguuaaccaggcccagucccguggcgguggcgguggcggcgguggcuacggcggcggucgcggcggcggcggcuaugguggcgggcgccgugacggcgguuauggcggcgguggcggcuacggcggucggcgcgagggu

SEQ ID NO: 5319 - RNA, 134 nt, Zea mays
accagauaguccggugcguuuugacuucgcagcucugacuucugacuucuacacugugcacuauucacuguucacaacagucgaccauugggcgcaguugacuguugcuucguuggcucaccggacauguccgg

SEQ ID NO: 5320 - RNA, 217 nt, Zea mays
uuccauuucggcugguauucugaucuacauggccuugguggaccucaucgcagcugauuuucucagcaagaggaugagcuguaacuugaggcuucaagucggcucauacauugccuuguuccuuggugccauggccauggcaucucuagccaucugggcuuagcaaguagaauggaaguaaggcaaagauuugagagugcugccuaauugccuuuga

SEQ ID NO: 5321 - RNA, 266 nt, Zea mays
cagagauggauggguuugacgcaaccagacaaauaaggcaaauggagaugagagcuaacgaggaaaggaagaacaaguuggcuuugacugaaggcucgacguccaucauuuacauguucuugcaaugacaaccgauguuauccgggcaacuuaugaggaguggauaaaaucuggaauggguggauucguguucuaaacccuucgacgaggagcagcuauaccaagcagucuccaaauuaguagugggaaugacggauucaguuguu

SEQ ID NO: 5322 - RNA, 117 nt, Zea mays
gauucgucuccuguuggcuguugccuucgaccgccuccaccucgucuccgacgauguccuccgucgccggugagggagaaggagagggaggaggacggcgccgacgggaggagccaa

SEQ ID NO: 5323 - RNA, 79 nt, Zea mays
cggcggcgacggggcugccguccgacgugccgcgcggccacuucgcgguguacgugggcgagcggcgccgccgcuucgu

SEQ ID NO: 5324 - RNA, 137 nt, Zea mays
gaaggcgguuaucgcucugaaugcagagaggcgguggguggucacugggacacccauucagaacagcucauuugauuuauauccccucauggcauuuuugagauuccagccuuucucaaucaagagcuacuggcaga

SEQ ID NO: 5325 - RNA, 76 nt, Zea mays
ucucccgagaaaagauggcggacuggguguucgugaucuccgcuugcagaauaccugucugcuacugaagcuccuc

SEQ ID NO: 5326 - RNA, 171 nt, Zea mays
cuaaauuuaucguucguacagacgggcucuuuucuuuaucuuguuaauuuaaaugcuaguuguugacgcugaauuggauuggaugacauaucaguaaggcuagauugcgcggaucgucacagaccgaaaaacacgugguaaagagcagguuuacgaaugaaaaaaaaaaaa

SEQ ID NO: 5327 - RNA, 150 nt, Zea mays
ggggcccguuuggcacaguuccagcuccugauucuaagcgaggaucuaaaggagccaugccaaacgggagaaucaggaggaucagcuccucacaaggaucaggaucuggagcuaaagaagcaggagcuggagcuuugccaaacgggcccu

SEQ ID NO: 5328 - RNA, 108 nt, Zea mays
acugagaguuccuuggcauucuguccaccucccuucuugacgaucuugcagaaaguuugcuuuuuuuguuuguuuggaggugggcauacugccaauggagcugcguag

SEQ ID NO: 5329 - RNA, 87 nt, Zea mays
ggccaaaagccgccgaaaauaaggccuuuaccgccgaaaauaagcuauuuuuggcggcuuuaggcuuauuuucggcggcuucuggcc

SEQ ID NO: 5330 - RNA, 106 nt, Zea mays
cagcaagcuugaggcagcaacugcauaacuugcgguaaaaucaucagcacaccaugguccaacaaguuuaucgcaaguuaugcaguugccggccucuagcuugcug

SEQ ID NO: 5331 - RNA, 475 nt, Zea mays
gccgagcuagcugcacuugacauagcaaccguugagacagaaugguugcgugaacucuugauggacuugccggugguugagaaaccaauaucagcuauccuuaugaacuaugacaaucagacagugauugcuaaagugacgaguucuaaggauaauggaaagucaucaagacauaucaaaagacgauugaagucuaucagaaaguugagaaacuccggaguuauaagugugacuuauauuucaacagauaaaaaucuggcagauccuuuuacgaagguucuaccacguaaugugauagaaaucgcaucgagagagauggagaccuuggaguacgacguauaugcuccacccgagaaggggacuacugguagccaaguacuggucaugacuucaagugaaacccauucacgcaaaacuugcaauucaaggcauaguccauuguccaaguuguggguugguguagcuuggaguucua

SEQ ID NO: 5332 - RNA, 73 nt, Zea mays
caaccauaagcgagccuauacacauuuuuccacacuuguugagcgauggccguacgagagcucacccuugcua

SEQ ID NO: 5333 - RNA, 133 nt, Zea mays
ggcgucggguccgccacgcuacacgguuccucgaggcgucccuacgcagccucgacggccacgacgacguguacgagugcgcgggacaguucggcaaggccggaggaccugccggcgugguggagagucggug

SEQ ID NO: 5334 - RNA, 67 nt, Zea mays
uugguagaagcugcgaaacucagcguugagguagacggcgcgcgaguuucuguuggcacgaaaaaga

SEQ ID NO: 5335 - RNA, 218 nt, Zea mays
cugugucguccacaguuggcuggccgagcuucucacucgugcucgaaucuggccacuaacgcccagccacacauccuucaucuccggcucgccgagcccgacccaaagccgucgugcgccccugcucccuuugccgucuccagccgucgcggcguccuuaguuuguuccggcaccgucgucuugcccagcucgaccaagccccgcuguuccucccuug

SEQ ID NO: 5336 - RNA, 93 nt, Zea mays
cgguguacucccuccguuucguuuuaguugucgcuggauaguacaaaauugaacuauccagcgacaacuuaaaaaaacggaggaaguauccug

SEQ ID NO: 5337 - RNA, 200 nt, Zea mays
gcggcagacgucggcggugcucgaugucgagggggaggaggccgcggcggcgcggcagcgccugcagcuccugcccacggaggcggacgaccuggcgguggacgccacggaggacggcgagggcaggcuggucgugcgagcgucgcugugcugcgaggaccgcgccggccucauccccgacaucgcccgcgcgcucgccg

SEQ ID NO: 5338 - RNA, 369 nt, Zea mays
gacgacaggaucgcaguggucaguagccgggucggccgguggccgcagauucucaccagcagcgccaucccucgccgucgcccggcgcuccagcccagggcaggagaggaagccacucugacucugucacucugagcuucgcgucaccugaguacugacggacgacaugggagaaguugaggacauguacacccaagacgggaccguggacaugaaagggaaucccgccgugaagaagggcaccggcaacuggcgcgccugccccuacauccucgcgaacgagugcugcgagaggcuggccuacuauggcaugagcaccaaccuggugaacuacaugaagacccggcuuggccaggugaacucugucgc

SEQ ID NO: 5339 - RNA, 246 nt, Zea mays
caagaggacaguugaacuucacugggguaagcaccaucaagauuacguggauggcuugaauaagcagcuggcuaccagcccucuguauggauauacgcuggaggaucugauaaaagaagccuacaacaauggcaauccauuaccagaauauaacaaugcagcacaggucuggaaccaucacuucuucugggaaucgaugcaaccagaaggugguggcuuaccugagggaggugugcugcagcagau

SEQ ID NO: 5340 - RNA, 186 nt, Zea mays
uauggaguguuuaaaagcacuagagcuaauagauaguuggcuaaaacuacuggugaauuuagcuaguuaacuauuagcuaacuugcuaaaaauaguuaauaguugaauuauuaacuaguauguuuggaugucuuuagcuaauuuuaacagcuaacuauuagcucuagugcauuuaaacacaccugu

SEQ ID NO: 5341 - RNA, 170 nt, Zea mays
gcugggagcucgacugccguaacaucaccgguaaccaggcccagucccguggcgggggcggugucggcggugacuacggcguagugcgggguggcggcggcgguuaugauggcgggcgccgugacggcggauauggcggcgguggcggcuacggcggucggcgcgaaggu

SEQ ID NO: 5342 - RNA, 171 nt, Zea mays
uaccuugacagugacacugaaacuaaauuugggccugauuucaacauucuuaugugguggcaacgccacaaucaaacuuauccuauucuuucuauacuagcuaaagauguguugacugucccuguuucuacaauaucuucagaaucuacuuucagucuagcuagcagggug

SEQ ID NO: 5343 - RNA, 183 nt, Zea mays
uugggugcgaucuguggugcagggguggugaaggguuuugagggcaagaaauuauacggcgacagcggcgguggugucaacuaugugcacagcgguuacaccaaaggagacggccucggugcugagauuguuggcacccucauccucgucuacaccgucuucuccgccaccgaugccaagcgu

SEQ ID NO: 5344 - RNA, 70 nt, Zea mays
agagcagcaacuccuacggcuccggcuccuccgacuugguggggucguggucgugggacgacgccgccgc

SEQ ID NO: 5345 - RNA, 62 nt, Zea mays
uucggcgacgccgagaagagcacgguggggaggcuggugcgcuucaucggggagaaggugug

SEQ ID NO: 5346 - RNA, 133 nt, Zea mays
uaauguuuagucccuucauuuuauuccuuuuuaguguauaaauugcuaaauauagaaacuaaaauaaaguuuuaguuucuauauuugguaauuuuggaacuaaaauggaauaaaaucuagggacuaaacauua

SEQ ID NO: 5347 - RNA, 114 nt, Zea mays
cgggcuccuguuggcuguugccuucgaccgccuccaucucgucuccgacgauguccuccgucgccggugagggggaaggagagggaggaggacggcgccgacgggaggagccaa

SEQ ID NO: 5348 - RNA, 100 nt, Zea mays
ugcucggccgagaucgaugccagagaugccuccuccgugccaucaaggacaaaggggauucccaaaaagggggacuuguugcgcgaucucagggaaggag

SEQ ID NO: 5349 - RNA, 133 nt, Zea mays
gcggcaccgaagcugucuucgggaaucugggcgccuugauagacaugugguuguucuuccuggagagcaccuugaacgucuucuccguguugaguuugugauccaaauuccgaagaaggcagccaaguugacg

SEQ ID NO: 5350 - RNA, 69 nt, Zea mays
aaggacguggugcuggacgaccacgacguggccaaguccgucgucgaguucgccgcgcacggcgccgua

SEQ ID NO: 5351 - RNA, 347 nt, Zea mays
uccgcccugcgcgccauggucgugccauagcugcucccuggccgaccuccguuucuucgcuggccggcccucaccuccacucagcucccauggcgcucggcgcccucuacuuuuccuccccacggccauucccccuccuagcucggcccuuccuuucccuccuggacucccccauggaacaacgucgugcuccuuaugcauauggcugugcgugggugcagcuugaagaagaacucgcugugcuaaugacguguggauccagggcuaaggaccgagagaugaugaucgagccauugauguggugccaaccacaagaugcaguugguggacgaccuggagaauggugg

SEQ ID NO: 5352 - RNA, 362 nt, Zea mays
gugcucgucuacaccgucuucuccgccaccgaccccaagcgcaacgcccgcgacucccacgucccgguucuggcuccccuccccaucggcuucgccguguucauggugcaccuggccaccauccccgucaccggcaccggcaucaacccggccaggagccugggcgccgccgucaucuacaacaaggacaagcccugggacgaccacuggaucuucugggugggcccucucgugggcgcugccaucgcggccuucuaccaccaguacauccuccgggcuggcgccaucaaggcccucggcuccuucaggagcaacgcgugaugagcggggcuuggcuguggagcaauggcgggcgaccuacg

SEQ ID NO: 5353 - RNA, 66 nt, Zea mays
uguuccuacugacaacucagacuugggugaaucugcacucgagacugagccagucauugagcaggu

SEQ ID NO: 5354 - RNA, 93 nt, Zea mays
cgugauacucccccguuucuuuuuaguugucgcuggauaguucaauuuugcacuauucagcgacaacuaaaacgaaacggagggaauauuuca

SEQ ID NO: 5355 - RNA, 94 nt, Zea mays
uaaaguacucccuccguuucguuuuaguugucgcuggauagugcaaaauugaacuauucagcgacaacuaaaaagaaacggagggaguaguugu

SEQ ID NO: 5356 - RNA, 60 nt, Zea mays
gcuggcagagggccaguagugugugugugugcugcgcgcgcgcgcgagcucgucuuugcc

SEQ ID NO: 5357 - RNA, 82 nt, Zea mays
cuuuguuuggguacucuuguauuaaccuuaauccaccucaauacaaguggauugaggucaauacuagaguacccaaacuaag

SEQ ID NO: 5358 - RNA, 240 nt, Zea mays
aguggcuguuggcgccggcaagaugaugaugcauuguuugagguggaguuuguuauuaugaugcuacaaagaauuugucucaagguugaguuugugaucauguucccuguuaguuuagguuucaccucuauaaauauucuuguaagccgcaggagauaguuaucucaauuauaaaucuccugugaucuguaaacacccgaaaaauacugagauuguugcugaccggcgccugugguuucc

SEQ ID NO: 5359 - RNA, 248 nt, Zea mays
  misc_feature (49)..(49): n is a, c, g, or u
agcagcggcaggaggaguggaggcggagggggugaugagggugcuggunguggacgacucccccgucgaccgccgggggacucgaaaaaaacggcacuccaucgccucaucuuauccgccggccuccucacgccgucgcugcugccugcucacuccccacucccgacuccccgacgcacgagcucccaggaguuagccauggccuccaccacccucuccuccgccuucagccuccucucccgccccuc

SEQ ID NO: 5360 - RNA, 73 nt, Zea mays
agagcagcaacuccuacggcuccggcuccuccgccgacuugguggggucguggucgugggacgacgacgacgc

SEQ ID NO: 5361 - RNA, 65 nt, Zea mays
ccgcgucccggacgugcgccucaucaccggggagaccgugcagggcggcaaguucagguuccgcg

SEQ ID NO: 5362 - RNA, 70 nt, Zea mays
agcgcagcaacuccuacggcuccggcuccuccgacuugguggggucguggucgugggacgacgacgcggc

SEQ ID NO: 5363 - RNA, 148 nt, Zea mays
ugauguuauaagggcuuguucguuugugccggauuagugggucggaacgauuucuaaccggauugcuucucuaauuuauauaaacuuugauuagcuggaacgauuccggguacaauccgacacaaacgaacaaggccuuaguuauucu

SEQ ID NO: 5364 - RNA, 128 nt, Zea mays
aggcacgcguguaguagcugcgguauuaguauauaugcuuagauguucagucacuuucuuuaaguacaauuuggcgcuggacauguaccuuauuuuacuauguauccgugacaacagcuaugugucug

SEQ ID NO: 5365 - RNA, 148 nt, Zea mays
accgcgacacgacggcgcucagccugcgccaucugguucgcaucacgucgugcccaaaggcgaagauguccuccucgccgugcagguuggccagcaugaccuucacgaucuccagcaugcgcagcugggugucccgggacgcgcccau

SEQ ID NO: 5366 - RNA, 65 nt, Zea mays
ucuaugccgagaguccugcucuugguaaacacggucauuaccgagagcaggacuuggccgaguau

SEQ ID NO: 5367 - RNA, 95 nt, Zea mays
cgguaggggcgcgcccguguuccuugccagcguccucgaguaccucgccgccgaggucauggagcuggcgggugccgcggcgcgugacagcaaga

SEQ ID NO: 5368 - RNA, 317 nt, Zea mays
ugugugugugaccgugcgugaggcgugaguccgugaccauucccgucggccgucccaaaagaagcgcaaauuuacaacccaguccaccacgggccacacaaucccaaaucuaacccuccgacggcgauggggaucucgagcaugccggagccgcgggacagccugcugggguaccugguguacaacacggugaucucgaucgcggcgcuggcggggcuggugcgggcggcgcugguguuccuggaccugcaggccgcgcugccgcccggggacgacggcggggaccgacuggcggcgucgggcccgggacuggcgga

SEQ ID NO: 5369 - RNA, 76 nt, Zea mays
ucaacucgcucgcgcgcugccucauccgcugggcgcgccgcgcgccggcagcggagggcggcggcggcggcgggcu

SEQ ID NO: 5370 - RNA, 133 nt, Zea mays
gcuaguuugcguacucuaguauugaccucaauccacuuguauugagguggauugagguguaacuuaaacuaauuuacaccuauccacuucaacacauguggauugaguccaauacuagaguauccaaacaaag

SEQ ID NO: 5371 - RNA, 139 nt, Zea mays
agccgcgacgccgcggaggccgucugcgccgcggggaaggugugcauggucagccuccgcggccgcggcgccaaggagggcgccgucuucgaccugcgcgccgcgcggugggaggacaugccgcccgggaugcucgcug

SEQ ID NO: 5372 - RNA, 138 nt, Zea mays
guguuucguuugaggucaaaguaggaugagacgagagagucugcucagagagacagucugcucgauuuuuuuaccacaccgccacuaaaaguugcccuggcguucaccucacuccccgaugacucucauccaaacauu

SEQ ID NO: 5373 - RNA, 148 nt, Zea mays
aacugguccaccucuuauuguuaaggcggaagaaccuuuggaggcggacgaauggauucgggucauggagcagaaauuuguauugauucgguguacaaagaaccagaagcccuuguucgcugcccagcaacugagaggucccgccagu

SEQ ID NO: 5374 - RNA, 120 nt, Zea mays
guuauggcggcgguggcggcuacggcggucggcgcgaggguggcgguggcggcuaccgaugcgguggcggcuacugcggccugcgcgaggguggugguggcggcuucccgcggcgguggc

SEQ ID NO: 5375 - RNA, 260 nt, Zea mays
agacauuggaggacauucaaaugagcuuaauggaaucagugaugaugauuguauggagggaaccucuucaagaauggcaggugucaauaaugauuauggugacauagcuggaacuugugaucuagguaagauuacugcagagcaguuagcaagacaaucaguuaaaaauguccggaaaagagaaauggaucgcaaggcacaggaaagggcccaacgugcaagaauccgucagcacaaugaagauguccugcgaaaugcgg

SEQ ID NO: 5376 - RNA, 95 nt, Zea mays
  misc_feature (16)..(16): n is a, c, g, or u
uagggugagugcucgngcguugcaacagagauauauaauacauaaguuaccgugauauuauauguccccguugcaacgcaugagcacucaccuau

SEQ ID NO: 5377 - RNA, 230 nt, Zea mays
ucgucaagucguccaagucgggcugcugucaguugcggcuccucugguuuguuugguuucacuuauuuccauugaauucaauaugacgacaaaugcuauugugguuaauaucacucucgauggucaaaauuauccggagugggcuuucuguguugagacugcacuccggggacauggauuacucuuccauuugacugaugcggcaccuguucuugcugaugaucgucgca

SEQ ID NO: 5378 - RNA, 64 nt, Zea mays
agaggguucggcgaacaguacaucggcaaagccuucuuugccgaguacuuuuucucgugccgag

SEQ ID NO: 5379 - RNA, 168 nt, Zea mays
cauggggaggcucgucgaggcgcugcagcaggccggguaccgcgacggagagacgcuguucggcgcgccguacgacuuccgccaggcucccgcggcgcgggggcagccgugccgugccuucgcgcgguucacccggcggcucagggcgcucguggagcgcgccagcag

SEQ ID NO: 5380 - RNA, 166 nt, Zea mays; identical to SEQ ID NO: 5318

SEQ ID NO: 5381 - RNA, 135 nt, Zea mays
cgucgaugggagacguccucuggaaccuggaguacguucugcagcuucaggacgccgauucgacggucucggaugugaacagcaugaaccguaucguggaacucccgucacagguccagaacgucggggcccucg

SEQ ID NO: 5382 - RNA, 104 nt, Zea mays
agcaagcucgagacaacaacugcauagcaugcaagagcuuguugguugagggucauaccgauggugcucuugcaaguuaugcaguugcugccucaagcuuccug

SEQ ID NO: 5383 - RNA, 73 nt, Zea mays; identical to SEQ ID NO: 5304

SEQ ID NO: 5384 - RNA, 107 nt, Zea mays
gaagcuacugccggguccagucaaggcggcuuaguuuaucugaaauacaccuucagauacaaagaucaauucgaugagucgaacgaugacuggcuggaucguauuga

SEQ ID NO: 5385 - RNA, 83 nt, Zea mays
ugaggggcugcucgaccuccucgaugcgguugaccucggauaaccaggucagcguggcggagcaggucgggcacgucgagcgu

SEQ ID NO: 5386 - RNA, 263 nt, Zea mays
aaucagagacgggaaguguagacguggcaugcacaucuuuaaaguggagcaccacgacauagcgcuaaccuucgagaggccagcaaaguuguuccugcaauuccugcacuuguagcccacauggcagcauguguagaacuaacacgaccagaugguaggggacgucgcauuguccuuuucauuuuagcaucauuauuuaucucaaacaccuucaaauaccuccaguugcucguguagccgcuucugaacuuccaguugcaucu

SEQ ID NO: 5387 - RNA, 100 nt, Zea mays
ugagcccuuccccgccagcauccaccgccgcggcguccccugcggcugagggaccggcugcugaugacuccgccggugcugcugcccuuggaaguggagc

SEQ ID NO: 5388 - RNA, 100 nt, Zea mays; identical to SEQ ID NO: 5387

SEQ ID NO: 5389 - RNA, 169 nt, Zea mays
uaacuacauuaaguuugaccaaguucauagaaaagaguauuaaguauuaguggcauugaggagaucaacuauaaaaauauauuucauaaauguaugaguugaaaaugauguucaucuauuauuguaaauauuauucuucucuauaaauuugccaaauuuaggauaguuu

SEQ ID NO: 5390 - RNA, 246 nt, Zea mays
agcaaugguggauguuuggaucgagguggaggcuaaccaguacaccgcugcacugaaccccauucucuuccagguccucaucaguccgaugcuugggggauccaccgaccagaaaguuguggaugagaaccuugagaagcugaagaaggugcuagagguguacgaggcacgccugaccaagugcaaguaccuugcuggagacuuccucagccucgccgaccugaaccaugugucugucacucucug

SEQ ID NO: 5391 - RNA, 92 nt, Zea mays
aauacauguaagggcccguuuggcacagcuccagcuccugauuuuaagcgaggaucuggaggagccgugccaaacggguuuuuuuaaacuga

SEQ ID NO: 5392 - RNA, 237 nt, Zea mays
aucgagcauaucgagaaggccuaccggacgcagucgcggcugcgccaccccgauaagcgccccgacgaccccaacgccaccgccgacuuccagcuccucucgaguuccuacaaacuccuccgcgacgagucccuucgccgccaguucgacgcgcgccuccgcggccgccgcgaggccgcagcccgcgccgccgccacgggcguuaagcgccggaaggccgucuccgaccucgaggag

SEQ ID NO: 5393 - RNA, 79 nt, Zea mays
gagccucgugguguucgcguggcacaagcucgacggcaagaaggccgcgcugcuggugccggccgucgccucggggcuc

SEQ ID NO: 5394 - RNA, 92 nt, Zea mays
uacgguacucccuccguuucguuuuaguugucgcuggauaguacaaaauugaacuauccagcgacaacuaaaaaaacggaggaaguauccug

SEQ ID NO: 5395 - RNA, 94 nt, Zea mays
auuuguacucccuccguuucuuuuuaguugucguuagauaguucaauuuugcacuauucagcgacaacuaaaacgaaacggagggaauaccuaa

SEQ ID NO: 5396 - RNA, 70 nt, Zea mays
agcgcagcaacuccuacggcuccggcuccuccgacuugguggggucguggucgugggacgacgacgacgc

SEQ ID NO: 5397 - RNA, 237 nt, Zea mays; identical to SEQ ID NO: 5392

SEQ ID NO: 5398 - RNA, 333 nt, Zea mays
auauagguuuugagagcgaggugcccgucugaacagguugcgcacgaggagagcccaccggccaccgccgaccgcaauggaagccgcaggcggcggagccgaggaugagcaggugaugagcgaggugcacuugggcugcccgccgcacuucucuggccuccucgucucccauuucagcuucuccucacggccccuagggccauauggacacaaaggaggcggcggcggcggcggcgggagcgagcuagucgcagcaacuagcgguucuggugauucgccugacgcagucgccguggaugaggauggggaucucguucuggaccggaggagaag

SEQ ID NO: 5399 - RNA, 67 nt, Zea mays
aaccugcagcuccaggaggugcucaccguccugccgcgggugugcaaguccuggggggcgggugguc

SEQ ID NO: 5400 - RNA, 89 nt, Zea mays
acacugucgcggauccucgcauugccgugggcaaggagcuacgcgucuuaaccaccgacgagcaagugaccgaggacccagguguucag

SEQ ID NO: 5401 - RNA, 70 nt, Zea mays
acgggaggcgaggucggcgcggcgucgucgcuggcccccaagaucggcccgcucggucucuccccgaaga

SEQ ID NO: 5402 - RNA, 71 nt, Zea mays
gacgggaggcgaggucggcgcggcgucgucgcuggcccccaagaucggcccgcucggucucuccccguaga

SEQ ID NO: 5403 - RNA, 113 nt, Zea mays
cgguacgaaggcgacggcggcggcgacggcggcguucaggaucgggaucucagcgacgacgucagaggcuucccaucccgacccccgccagucgccucgcgcccucgacuccg

SEQ ID NO: 5404 - RNA, 458 nt, Zea mays
auauagguuuugagagcgaggugcccgucugaacagguugcgcacgaggagagcccaccggccaccgccgaccgcaauggaagccgcaggcggcggagccgaggaugagcaggugaugagcgaggugcacuugggcugcccgccgcacuucucuggccuccucgucucccauuucagcuucuccucacggccccuagggccauauggacacaaaggaggcggcggcggcggcggcgggagcgagcuagucgcagcaacuagcgguucugguaacugagugggacuguggaucaguggauguguauuugcguuaguucguguugacguagagguuaguuuugugcguauguguugaauugcucguugguguaacaugauuuacucuguugaggaggugauucgccugacgcagucgccguggaugaggauggggaucucguucuggaccggaggagaag

SEQ ID NO: 5405 - RNA, 236 nt, Zea mays
caucaauucaucagcuagaaguucgaaaugggggucaaguuuuuaguccuucucgguguuguccuggccucucuugucuuccaggacguggcauuugcuagagagcucacugaggccaauaaugaggaugagggaaagaacaugaaacaaggaggaaugacugaauuaaaggaugagaaauggggagguggauauggaaaaccgggcuauggugguggauaugguggaggauacag

SEQ ID NO: 5406 - RNA, 89 nt, Zea mays
gcggcuacggcgguggcgggcgccgugauggcggcggcggcuacagcgguggcggcggcuacgguggcggcggcggcuacggugguggu

SEQ ID NO: 5407 - RNA, 77 nt, Zea mays
ucaacgucgcccugcagauggaggaugucgaggucgucgccggcaacgaccccuucaucaccacggauuacaugacc

SEQ ID NO: 5408 - RNA, 59 nt, Zea mays
gcuggcagagggccaguagugugugugugugugcgcgcgcgcgcgagcuugucuuugcc

SEQ ID NO: 5409 - RNA, 85 nt, Zea mays
cagcaagcucccgcccgccgucgucgccugagguagacaccaauccgccgccauggggcguaugcacagccgcgggaaggguauc

SEQ ID NO: 5410 - RNA, 140 nt, Zea mays
uguucggcguccucuccuucguccucaccgaccucaagaaagaauuacgaaugaaaacuuuugauaccaccuaccccucuguaaacuccuugagggcugauuuggugaccagcgauaucgggaggaucggaguggauuga

SEQ ID NO: 5411 - RNA, 213 nt, Zea mays
aaagagaacaguugaacuucacugggguaagcaccaucaagauuacguggauggcuugaauaaguagcuggcuaccagcccucuguauguauauacacucuggacgaucugauaaaagaagcccacaacaauggucucgaaucaucacuuuuucugggaaucgaugcaaccagaaggugguggcuuaccugagggaggugugcuauagcagau

SEQ ID NO: 5412 - RNA, 115 nt, Zea mays
acacugagcgggugagaggcacgaugcacgacaaaauauuagguuauuccuuuaucaugcuacugaugcgguuuccccaauucucuugcaguguccuccucuucccaauugcagu

SEQ ID NO: 5413 - RNA, 269 nt, Zea mays
ggucgacauguucugcaccgacgcgcucgacgucgccgcggagcucgcgauccccgcgcacuucuucuacccguccgcggccggcgaccucgcggucuaccuccagguuccagaucucugccgcgccgcgccguccccgcuaagggacaugggcaaggcggcgcugaacuucgccggcgugccggcgguccgcgcucucgacaugcccgacaccaugcacgacugggagagcgacgugggcagcguacggcugcggcagcucgcccgga

SEQ ID NO: 5414 - RNA, 246 nt, Zea mays
caagaggacaguugaacuucacugggguaagcaccaucaagauuacguggaugacuugaauaagcagcuggcuaccagcccucuguauggauacacgcuggaggaucugauaaaagaagccuacaacaauggcaauccauuaccagaauauaacaaugcagcacaggucuggaacaaucacuucuucugggaaucaaugcaacuagaaggugguggcuuaccugagggaggugugcugcagcagau

SEQ ID NO: 5415 - RNA, 83 nt, Zea mays
ugauuuagaguuggcagccgugguucauccauugaaaauguggaggcacuacuugaugggaacccacugcaacaucuauacug

SEQ ID NO: 5416 - RNA, 75 nt, Zea mays
caaguccacgccggcgaccgccguggcugcggcuucagucuccgccacggccgcugcggccgccgccguggcagu

SEQ ID NO: 5417 - RNA, 63 nt, Zea mays
aacauccguuguguuuauauucugcucgacaacgaguacggauuuaagcacgugauaucagug

SEQ ID NO: 5418 - RNA, 127 nt, Zea mays
gcaaaagcacggacaggugcucggcgugcugcaacggcuuccgauuugcccggcuggauggaagacggcuggggagcaucuucucuggggaacaccgcgcgucaugggugccuugccgaaguucagg

SEQ ID NO: 5419 - RNA, 128 nt, Zea mays
aggcacgcguguaguagcugcgguauuaguauauaugcuuagauguucagucacuuucuuuaaguacaaucuggcgcuggacauguaccuuauuuuacuauguauccgugacaacagcuaugugucug

SEQ ID NO: 5420 - RNA, 178 nt, Zea mays
cgcugggcgggcacuucaggucccucgccgaugucuaccgccucuucggccucgacgaccucggccggcucccggaggccaaggcggucaucaacagcggcgcgccguuccccgucgugccucaggucauuucagugaacccgacacauuggcggaaggacgaagaguucgcgcggca

SEQ ID NO: 5421 - RNA, 77 nt, Zea mays
gcucgcagcagcucggcucggcucggaccggcucgacgcucagaacgagcccgagccuggcucgcugacucguggcu

SEQ ID NO: 5422 - RNA, 80 nt, Zea mays
cguggcugcgaccugcgacgaggagccucgcgcgagcuacgccugcggccugcgacgagccccgagcggucgagcugcgc

SEQ ID NO: 5423 - RNA, 462 nt, Zea mays
cagucaagaagcaaggcaagagauccgcggaagagauccugauuguaggucccguucccucagauagacuggccuauuuugccccagcuuccgagaccagacucgaggaagcugccccuccugacggggauuggacgcgaaggauggagcauccgaacauugaauucgagcuaagauucuaacgaacagcuggaauaaagaaccuauccuuucaggaauaaggaaugagaaauggaacagagagugguuggauggaguauaaaaucuaaagguuauauuauauauaguagugggaagaaaaaaagacaagaaaacgauugaaugucaggcaaaacaguucuguaagucgcggaucaaagccugaagugaagugccugguugucuuaguauuauaaguaaagcauuucauucuccgguuuugauuucauucucuuuugugacggucuacuugcuugugcuaag

SEQ ID NO: 5424 - RNA, 66 nt, Zea mays
gcagcacgcugucgaccgugaggaugaccgugggggggucgucgagcacgguggacgcgaugcggg

SEQ ID NO: 5425 - RNA, 68 nt, Zea mays
ucaagcaaggugggcggugcugcgagguccagcguaugguugggaucguaaucguuuaacugaaauaa

SEQ ID NO: 5426 - RNA, 81 nt, Zea mays
gcucuggccgcgguggcgcugguggugguggccgucgucaucacgguggucugcgcucgccaccgucgccgcggccaccag

SEQ ID NO: 5427 - RNA, 64 nt, Zea mays
aucgaugccgauggcgugucagcagcaugcuccucgguccucuguucgucgucguucgugccuu

SEQ ID NO: 5428 - RNA, 77 nt, Zea mays
ggcgacagcacccgccggcgggaccucauguucagcgucgugaagccguccgugauccagcugcggggccccaccaa

SEQ ID NO: 5429 - RNA, 71 nt, Zea mays
guuacgcguggcggcugaugugugggcuaggucacgaccagcuccaugcguuagucaaccaguugcagcua

SEQ ID NO: 5430 - RNA, 94 nt, Zea mays
auauauacucccuccguuucguuuuaguugucgcuggauagugcaaaauugaacuauucagcgacaucuaaaaagaaacggagggaggaguaua

SEQ ID NO: 5431 - RNA, 295 nt, Zea mays
gugcggcaggguccucauccuggaccugcaggaggaugcgguggcggcuccaccuccacggcagcuguggcgaccaugucaccgcaugacaugaagaagauaaaaaaaaaacuagacgcggaccauccgagcccuacacgcagaccauccggugugacacagagaagauuugcuccugcagcaaggucgcggauguguggccccaagccacggaucgucucagcccuacacguggaccauccggugacacagagaagauccgcuccugcagcgaggucgcggaccaucuggcccc

SEQ ID NO: 5432 - RNA, 63 nt, Zea mays
gcaauagauuuauguucggugaggaugcaagcgcggacucacuccgaauggugaaucauggag

SEQ ID NO: 5433 - RNA, 140 nt, Zea mays
aggacuuguucgguuagcucucaauccauguggauuaaguaggauuggauggguuugaaucucaaaccaaguuaaacuucuucuuaauuuuuuccaaucccauccaauccauguguauugggaauaaccgaacaagcucu

SEQ ID NO: 5434 - RNA, 244 nt, Zea mays
gguguucuugccauugucguggaccucguccugcuccucucuacgccggugcgugcccaaguccucguccaagcaccagccgugccucuggccuuuggucgucgugcugugcgcgaggacuacccugccuuaucacgcgugugcguuaucgaucucgucgucguuccgugcgucaucaagaaaucccaagagucgggugaagacgaagcuagcagcgugauguucaccaagugcucgacacaag

SEQ ID NO: 5435 - RNA, 357 nt, Zea mays
gccgcugucccuccccguccgccgagccguugccccuguggcugugcugugccuccguucgccggccgagccgcuguccgccugucacugucccucaguccgccgagcugcugugcuuuccggcuucgccguccgccgaacagguucguccgcgagcgcgacgcgccgagcuuccgccguccgccgagcagguccguccgccaagccauaccuaaauuuuuuuccguccuccgccacugagggcaggggagcggagagccgccgccauggcggaggaggcggaggggauggaccgguucgauauggagggggacuucgagggcgggcgguucggccgcgacggggaguuuuacuacc

SEQ ID NO: 5436 - RNA, 121 nt, Zea mays
cuucucaucgccuccauuccugugcugccaaagccuuagauuccuauggcucgaccacugccaggacaugcuggagagcggcccagauggagcggcacagaugugggaggcagauggcauc

SEQ ID NO: 5437 - RNA, 154 nt, Zea mays
gaagauauuguuaagggccuguucgguuguaccggaaugagccaggauucauuccagcucaucaaaaucuauauaaauuagagaaguaauccagcuaggaauuaauccggggcuccaauccggaacaaccgaacagggccuaagcugguuagcu

SEQ ID NO: 5438 - RNA, 75 nt, Zea mays; identical to SEQ ID NO: 5416

SEQ ID NO: 5439 - RNA, 127 nt, Zea mays; identical to SEQ ID NO: 5418

SEQ ID NO: 5440 - RNA, 148 nt, Zea mays
uuuucaauaucaggaaggcuacuuuuugcugguuacuccaauggugacuguuaugugugggacacacuucucgccgaggugguacuuaauuugggaaaccugcaaaacucccaugauggccguauaaguugccucgggaugucaucug

SEQ ID NO: 5441 - RNA, 127 nt, Zea mays
ggcggcgauggcgguggaggugguugcuuuguccugguuccuggccggucguuuugcugggguuuucuugggcgaaagcuuuggcgacgccccugggcgccgcuuccccuguugagggugucggcuc

SEQ ID NO: 5442 - RNA, 204 nt, Zea mays
gacggcgcagcagcguuccaaguccaucgagggcgccaucgacaccggcuucucguucaagaacugcagcaucggcggcgucaagggcggccagaucuaccugggccgcgccuggggggacuccucccgggucgucuacucguacacgaagaugggggaggaggugguccccgugggcugggacggcuggcagaucgccaagcc

SEQ ID NO: 5443 - RNA, 140 nt, Zea mays
ugcaggccgccgcgacggcgcuggcgguggccgggcuggccgcggcuggcggguggcgggaggagcuggcgcgcugggaccucucgccggccgcguacugggcccugguggccgcgcugguugugacguggcaggccugc

SEQ ID NO: 5444 - RNA, 259 nt, Zea mays
cuuaguacuuccuccguuucgucuuacaagucguuuccaacagcuuuguacagauuaaggaaucuaugaauugacuauuuugcccucccacaagccuccgcuuaggccuuggcauuucguccaaccuuagcugguaaacaccugcuggaagggcaaaaaugguaguuuacuuuuuacuuuaacuagagcgacaacuauuaugacucguuuuguuuugcacuagcggcgacaacuaaaacgaaacggagggaguaucuac

SEQ ID NO: 5445 - RNA, 101 nt, Zea mays
gauucuauugcauuuaaggguguauuaaagagaaagauuuaucuaguuguuuucucgaacgauaauguugaacuugaugcaugcuuaauugcuaaaaccaa

SEQ ID NO: 5446 - RNA, 292 nt, Zea mays
guuauggcggcgguggcggcuacggcggucggcgcgaagguggcggcggcggcuacggaggcgguggcggcuacggcggucggcgcgaggguggcgguggcggcuacggcggcgguggcggcggcggcuggagggacugaugugugggcccauccuggcuucggccgaguuaucuuaucuaucuauaguaucguguuaccguucgcuucugucaccguguuaguguccguucuaccuuuggauuagguguugguacccuguuguucgcuuugguugcucccgcuaugaaacg

SEQ ID NO: 5447 - RNA, 75 nt, Zea mays
gguucugcagugaguuggaggguuucacuucagucuguuacugcucuuuccacuacuaguagaauaugucucaac

SEQ ID NO: 5448 - RNA, 319 nt, Zea mays
ucgccgucaacgaccccuucaucaccacggauuacaugacguacauguucaaguacgacaccgugcacggccaauggaagcacagcgacaucgcccucaaggacuccaagacgcuucucuucggcgagaagccggucaccgucuuuggcaucagcugugagcuaguguuugaaccgcugcgagucuacaggaaccccgaggagaucccguggggugaggcuggugcugaguaugucguggaguccaccggugucuucacugacaaggacaaggcugcugcacaucugaaggguggugccaagaagguuguuaucucugc

SEQ ID NO: 5449 - RNA, 93 nt, Zea mays
uuuaauacucccuccguuucguuuuaguugucgcuggauagugcaaaauugaaccauccagcgacaacuaaaaagaaacggagugaguauuug

SEQ ID NO: 5450 - RNA, 178 nt, Zea mays; identical to SEQ ID NO: 5420

SEQ ID NO: 5451 - RNA, 167 nt, Zea mays
gcaaggagcucgacggccguaacaucaccguuaaccaggcccagucccguggcgguggcgguggcggcgguggcuacggcggcggucgcggcggcggcggcuaugguggcgggcgccgugacggcgguuauggcggcgguggcggcuacggcggucggcgcgagggu

SEQ ID NO: 5452 - RNA, 166 nt, Zea mays; identical to SEQ ID NO: 5318

SEQ ID NO: 5453 - RNA, 161 nt, Zea mays
cgccccacacacgccguugccaccuccuagaacccgacuagauccgggcagacgcgaccaaagcagagaaaaaucgccgcgucgccaccuuccuuggggccgcgcggacauccggcggcgcccucuggugacggcgaggugggauggaguggagggagggg

SEQ ID NO: 5454 - RNA, 114 nt, Zea mays
cugaagaguuccuuggcauucuguccaccuccucucgccgaucuugcagaaaguuuaccaguucuguugcauuuuuuuuuuggaggugggcauacugccaauggagcugugcag

SEQ ID NO: 5455 - RNA, 70 nt, Zea mays
gacagaggcgaggucggcgcggcgucgucgcuggcccccaagaucggcccgcucggucucuccccgaaga

SEQ ID NO: 5456 - RNA, 148 nt, Zea mays; identical to SEQ ID NO: 5440

SEQ ID NO: 5457 - RNA, 69 nt, Zea mays; identical to SEQ ID NO: 5350

SEQ ID NO: 5458 - RNA, 70 nt, Zea mays; identical to SEQ ID NO: 5401

SEQ ID NO: 5459 - RNA, 141 nt, Zea mays
gcuccggcggcgcgaucccauuuccuggacgcaggcgcgacgcgauggcagcggagaaagaagaagcucccgacgccccgggccgcaugcaagugagaagcguacgcgccagagggacugggccgcgcgaagugggaguug

SEQ ID NO: 5460 - RNA, 176 nt, Zea mays
acccucgcgccgaccgccguagccgccaccgccgccauaaccguaaccgccgucacggcgcccgccaccauaaccgccgccgccgccgcgaccgccgccguagccaccgccgccaccgccaccgccacgggacugggccugguuaacggugauguuacggccgucgagcuccuugc

SEQ ID NO: 5461 - RNA, 87 nt, Zea mays
augcuagcuucgucuucacucgacuuuugugauuucuugaugaugcacgaaacgacaacgagauccagucuggagcgagcuggcgag

SEQ ID NO: 5462 - RNA, 60 nt, Zea mays
uaacgucuaugcacaauaaggcgaggacgagagcgucuuccuuugcugguaugacuacuu

SEQ ID NO: 5463 - RNA, 109 nt, Zea mays
cguuugaucccaaaaccauagggauugagggggauuggaagggauugaagaggauuuugacuuguaggggauuuaaucccccucaaucccuauggauuggcacaaaacg

SEQ ID NO: 5464 - RNA, 163 nt, Zea mays
cuuugauuaggucuuguucguuucugucggauuggugggucggaacgauucuugaccggauugcuucucuaauuuauauaaacuuugauuagcuggaacuauuccggguaggaaucguuccgacccacuaauccggcacaaacgaacaaggccuuaguuggaa

SEQ ID NO: 5465 - RNA, 133 nt, Zea mays
uaauguuuagucccuucauuuuauucauuuuuaguguauaaauugcuaaauauagaaacuaaaauaaaguuuuaguuucuauauuugguaauuuuggaacuaaaauggaauaaaaucuagggacuaaacauua

SEQ ID NO: 5466 - RNA, 107 nt, Zea mays
ccugcggauuagcucgcgcuuggggucgacuuggaucaucuuccgcaucacgcgauugauuaacguaccguuuccacaguugacacgaguccgcgagaucgguagug

SEQ ID NO: 5467 - RNA, 71 nt, Zea mays
cucaaucccuggaaggguuacagauaccugagaaaauuuuacaacgucgucugaacucugcaggguugucu

SEQ ID NO: 5468 - RNA, 71 nt, Zea mays
augucuucgcccgagcuccaggaaucuucugcgcgaaugcugaagguuaccggggugauggagaaggaucg

SEQ ID NO: 5469 - RNA, 271 nt, Zea mays
aaauagcuacaagguucuauugaugacccaugaugucauggagaguggagguaagacccaucuaaggugccaucuagcugguuugucaggagauggcaagucaugccugaauguaccuagggaaaaaaggagggcaaaaucuaaagagcauaaacucuuuguggauaaggcaauuauggaucuagcauaugguggugcuagaagagaacaaauaccuagggaugaagcuggacagauggcgugggcacuaagggaaucauuguuggaucaa

SEQ ID NO: 5470 - RNA, 66 nt, Zea mays
guuuucggauauuuuugucgucagcucgaucauuuuugaacuaaacggcgauaaauaaaaaaaaga

SEQ ID NO: 5471 - RNA, 192 nt, Zea mays
acccuuacgccuucgcucgcgccgccgccgccgccgccgcuacgccccgcaccucgcuucauuucgugucgccaagaugacgaagcgcacuaagaaggcaggaauuguuggcaaauauggaaccagguauggugcuagggugguggcggcggcuacggaggcgguggcggcuacggcggucggcgcgagggu

SEQ ID NO: 5472 - RNA, 83 nt, Zea mays
ucccuccauggcggcggcgguggcggcggucgcggcugccacgacggcggaggacgaggcgcgccugcugcgucuggaggagc

SEQ ID NO: 5473 - RNA, 137 nt, Zea mays; identical to SEQ ID NO: 5324

SEQ ID NO: 5474 - RNA, 72 nt, Zea mays
agccgcgacgccgcggaggccgucugcgccgcggggaaggugugcauggucagccuccgcggccgcggcgcc

SEQ ID NO: 5475 - RNA, 87 nt, Zea mays
ggcuagcagggacggcgugcgggucgcggcgggauucgcgggcgguugcgggcgugcggcgcggcauggacggcgucaagcgguggg

SEQ ID NO: 5476 - RNA, 246 nt, Zea mays
agcaaugguggauguuuggaucgagguggaggcuaaccaguacaccgcugcacugaaucccauccucuuccagguccucaucaguccuaugcuugggggaaccaccgaccagaaaguuguggaugagaaccuugagaagcugaagaaggugcuagagguguacgaggcacgccugaccaagugcaaguaccuugcuggagacuuccucagccucgccgaccugaaccaugugucugucacucucug

SEQ ID NO: 5477 - RNA, 79 nt, Zea mays
ggccguguacagcuccaucuggaacgcggacgacugggcgacgcagggcgggcgcgugaagacggacuggucgcacgcg

SEQ ID NO: 5478 - RNA, 366 nt, Zea mays
gacgacaggaucgcaguggucaguagccgggucggccgguggccgcagauucucaccagcagcgccaucccucgccgucgcccggcgcuccagcccagggcaggagaggaggccacucugacugucacucugagcuucgcgucaccugaguacugacggacgacauggggaaguugaggacauguacacccaagacgggaccguggacaugaaagggaaucccgccgugaagaagggcaccggcaacuggcgcgccugccccuacauccucgcgaacgagugcugcgagaggcuggcuuacuauggcaugagcaccaaccuggugaacuacaugaagacccgacuuggccaggugaacuccguugc

SEQ ID NO: 5479 - RNA, 263 nt, Zea mays
agccgccggggccgcgccggugcccaccggucggggcugcgcucccgcgcagaagcgcgucgggcuacuggcugccgggccgcugcgucaagugccugcgcccccgcgccgcgaggaccugcacgcccgggaagccguugcccgcgccgccagggcuaggccgccgugccgaggccgcgcccgccuggcugacgagccgccgcgccgccgggaccggggccgaauccgcccgccgagacgggcccgcgcacgcccggggaacu

SEQ ID NO: 5480 - RNA, 161 nt, Zea mays
ggaguaggcaucacauggcuccgucagucuuuuggugugugcccugcugaugcugaugaggguacauuccaguucuauugucgagcuuggauccugcacauguuugguuguguucucuucccagacgccacaggagacugcgcgucauggauguacauccc

SEQ ID NO: 5481 - RNA, 74 nt, Zea mays
caaaaagcuugaacgagucguacugccaucgucuucgucgcgcuggcacgucgaugucgucauuugccuucgca

SEQ ID NO: 5482 - RNA, 93 nt, Zea mays
ugcugaagccgcuggggcagauggugaucgugggcgcgccgagcaagccgcucgagcugccggccuacgccaucgugccgggcgggaagggcg

SEQ ID NO: 5483 - RNA, 97 nt, Zea mays
ggucuguuugguuucuggauaacugucacacuuugccuaaccuuugacagaaaaguuagauaaaguaugacaaguuagacagcgaaccaaauauaac

SEQ ID NO: 5484 - RNA, 70 nt, Zea mays; identical to SEQ ID NO: 5401

SEQ ID NO: 5485 - RNA, 433 nt, Zea mays
gacgacaggaucgcaguggucaguagccgggucggccgguggccgcagauucucaccagcagcgccaucccucgccgucgcccggcgcuccagcccagucuacuacucaugcaagaagaaucguucacacccugaagaacaagaaucgguguguauuugcagggcaggagaggaagccacucugacucugucacucugagcuucgcgucaccugaguacugacggacgacaugggagaaguugaggacauguacacccaagacgggaccguggacaugaaagggaaucccgccgugaagaagggcaccggcaacuggcgcgccugccccuacauccucgcgaacgagugcugcgagaggcuggccuacuauggcaugagcaccaaccuggugaacuacaugaagacccggcuuggccaggugaacucugucgc

SEQ ID NO: 5486 - RNA, 70 nt, Zea mays
gaccgggcgcggccugcagcggagacggggaggagccccuucacugcugugccugccggcguugcuuugu

SEQ ID NO: 5487 - RNA, 66 nt, Zea mays
cgccgacuaccgcaacgugauggccgccgccgugcgcggcgacuacgacacgugcggccuguacgc

SEQ ID NO: 5488 - RNA, 78 nt, Zea mays
guccuaucuaccagccggcugggugggcugcucggccuuugguccuuguagcggcccagccuggcuggccauuuuuuu

SEQ ID NO: 5489 - RNA, 181 nt, Zea mays
ugauacccuugacuaaguugaauaauguuuucacgauaugguuugguuuaacagucucaggcauggcugaagaccgugcaaggauguacaauggcuggaguaggaauggacgucauuugaugauuggguagccaagaccaaagauuuuguggaccacguauucuccuugucauuaaccggc

SEQ ID NO: 5490 - RNA, 362 nt, Zea mays
gugcucgucuacaccgucuucuccgccaccgaccccaagcgcaacgcccgcgacucccacgucccgguucuggcuccccuccccaucggcuucgccguguucauggugcaccuggccaccauccccgucaccggcaccggcaucaacccggccaggagccugggcgccgccgucaucuacaacaaggacaagcccugggacgaccacuggaucuucugggugggcccccucgugggcgcugccaucgcggccuucuaccaccaguacauccuccgggcuggcgccaucaaggcccucggcuccuucaggagcaacgcgugaugagcggggcuuggcuguggagcaauggcgggcgaccuacg

SEQ ID NO: 5491 - RNA, 80 nt, Zea mays
cgugcgggugacuggcggcgaggucgucgcggcgucuucccuggcgcccaagaucggcccgcucggucucuccccguaga

SEQ ID NO: 5492 - RNA, 113 nt, Zea mays; identical to SEQ ID NO: 5403

SEQ ID NO: 5493 - RNA, 92 nt, Zea mays
cccggcacgaucggaccuccaccgugccgugcucgggaagagguauaagcccgucggcggcacggcacgguuaaguggccgagcucaaacgg

SEQ ID NO: 5494 - RNA, 74 nt, Zea mays
gccuucacggacgucugcaucggcuggccgggcuccauguccgacgccgacgugcucgaccgcuccgcgcucua

SEQ ID NO: 5495 - RNA, 110 nt, Zea mays
aaaaugugggcggagaggguggucggcgagcgccggaugcggcagauccagcgcuucgcgcggaacgccaagcucaccgucgucugccuccuccucaccguaguugugcu

SEQ ID NO: 5496 - RNA, 192 nt, Zea mays
gauucucggccgcgucccggagccugcccaccguucccacuccggucaaaaagaguugucuuuggacaauucagcgaauucgucacagacaauggguucuuuuuugauccucgacaacuacgacugguggaaggacaucacgcugcuggauuuccugagagaggugggccguuuugcacgcguggguacaau

SEQ ID NO: 5497 - RNA, 91 nt, Zea mays
ccgccgcugcugcaagcgccagcucgccgucguccgaauaguacacucuaacgccgccauggggcguaugcacagccgcgggaaggguauc

SEQ ID NO: 5498 - RNA, 24 nt, Zea mays
auccagcgacaacuaaaacgaaac

SEQ ID NO: 5499 - RNA, 24 nt, Zea mays
uccccacggguuggcggguaucgg

SEQ ID NO: 5500 - RNA, 21 nt, Zea mays
uguugucucaagcuugcugcc

SEQ ID NO: 5501 - RNA, 22 nt, Zea mays
gcacagauugcucugcgagugc

SEQ ID NO: 5502 - RNA, 24 nt, Zea mays
aaacugauauaucagccgugcuca

SEQ ID NO: 5503 - RNA, 24 nt, Zea mays
ccagcgacaacuaaaacgaaacgg

SEQ ID NO: 5504 - RNA, 24 nt, Zea mays
ccccugaucaguaggagggcucgg

SEQ ID NO: 5505 - RNA, 24 nt, Zea mays
acucuauggaguuuuuggagcugc

SEQ ID NO: 5506 - RNA, 22 nt, Zea mays
cggggucaccaucgcgcacggc

SEQ ID NO: 5507 - RNA, 22 nt, Zea mays
ucuugugugcccacauauccaa

SEQ ID NO: 5508 - RNA, 24 nt, Zea mays
aucgagccacgaguauuucgucca

SEQ ID NO: 5509 - RNA, 24 nt, Zea mays
ggaacgauuccgggugcaauccga

SEQ ID NO: 5510 - RNA, 22 nt, Zea mays
cacaaacgcaacggaguucugu

SEQ ID NO: 5511 - RNA, 22 nt, Zea mays
cggaugggugcugcgcgguggu

SEQ ID NO: 5512 - RNA, 20 nt, Zea mays
cggccugcuaacugugucgg

SEQ ID NO: 5513 - RNA, 24 nt, Zea mays
cgccuucucgacugcggaaccggu

SEQ ID NO: 5514 - RNA, 20 nt, Zea mays
uggcaauggcggaccaggcu

SEQ ID NO: 5515 - RNA, 22 nt, Zea mays
caccagacaguccggugcgcca

SEQ ID NO: 5516 - RNA, 23 nt, Zea mays
uacgcuccggcggcccgaaccac

SEQ ID NO: 5517 - RNA, 22 nt, Zea mays
ugauguucuguaaugucugcaa

SEQ ID NO: 5518 - RNA, 24 nt, Zea mays
guaacguaauggguaacugauaac

SEQ ID NO: 5519 - RNA, 20 nt, Zea mays
acgggucagucagccgcggg

SEQ ID NO: 5520 - RNA, 22 nt, Zea mays
aggaacaaagcccgacuugugg

SEQ ID NO: 5521 - RNA, 20 nt, Zea mays
gacguguucgccuacggggu

SEQ ID NO: 5522 - RNA, 24 nt, Zea mays
uggccggagucggucgguccacgc

SEQ ID NO: 5523 - RNA, 24 nt, Zea mays
agagaaucugaguaucauuaggau

SEQ ID NO: 5524 - RNA, 23 nt, Zea mays
cgaacucaucgcagcauccucca

SEQ ID NO: 5525 - RNA, 21 nt, Zea mays
agagcguccuucaguccacuc

SEQ ID NO: 5526 - RNA, 24 nt, Zea mays
ucaugguacagaaacgaaugucac

SEQ ID NO: 5527 - RNA, 20 nt, Zea mays
cgacggcgacgggggcgggu

SEQ ID NO: 5528 - RNA, 22 nt, Zea mays
cgguguacaccggacauguccg

SEQ ID NO: 5529 - RNA, 20 nt, Zea mays
uggcgcaccgaacacugucc

SEQ ID NO: 5530 - RNA, 23 nt, Zea mays
cucgucgguccagggacccccgg

SEQ ID NO: 5531 - RNA, 24 nt, Zea mays
cgccgucgucggguuccuugccgu

SEQ ID NO: 5532 - RNA, 24 nt, Zea mays
gacaaccgacgggaauaagcccua

SEQ ID NO: 5533 - RNA, 23 nt, Zea mays
accggacaguccggugugccaga

SEQ ID NO: 5534 - RNA, 21 nt, Zea mays
accuggcacaucuugcgcguc

SEQ ID NO: 5535 - RNA, 20 nt, Zea mays
ugcacugccucuucccuggc

SEQ ID NO: 5536 - RNA, 21 nt, Zea mays
gacgguccgcgaccuggcgca

SEQ ID NO: 5537 - RNA, 25 nt, Zea mays
cacauucuuggauuucugguggaga

SEQ ID NO: 5538 - RNA, 21 nt, Zea mays
uggagaagcagggcacgugca

SEQ ID NO: 5539 - RNA, 22 nt, Zea mays
gggaaggaugucuucgcccgag

SEQ ID NO: 5540 - RNA, 25 nt, Zea mays
gugacgauggccuggaugcgcgccu

SEQ ID NO: 5541 - RNA, 21 nt, Zea mays
uagccaaggaugacuugccug

SEQ ID NO: 5542 - RNA, 24 nt, Zea mays
ggagccacacaacgaggaguucga

SEQ ID NO: 5543 - RNA, 22 nt, Zea mays
cgagccgagggauuccuacgcc

SEQ ID NO: 5544 - RNA, 24 nt, Zea mays
caccgccucugcgcacccguggac

SEQ ID NO: 5545 - RNA, 21 nt, Zea mays
uuuggauugaagggagcucug

SEQ ID NO: 5546 - RNA, 24 nt, Zea mays
cuccacaugcacaacggucugcgc

SEQ ID NO: 5547 - RNA, 24 nt, Zea mays
ugucgcaguagacgaggguggcgc

SEQ ID NO: 5548 - RNA, 22 nt, Zea mays
uccaccgguucaugucgccagu

SEQ ID NO: 5549 - RNA, 24 nt, Zea mays
ccugcacucgguaaaccagcucgu

SEQ ID NO: 5550 - RNA, 24 nt, Zea mays
cccgugagauugaaacggggccua

SEQ ID NO: 5551 - RNA, 24 nt, Zea mays
uaaucccaccaugggauugggugu

SEQ ID NO: 5552 - RNA, 24 nt, Zea mays
aggaccgagagaugaugaucgagc

SEQ ID NO: 5553 - RNA, 24 nt, Zea mays
gucgguccuagucggucccugguc

SEQ ID NO: 5554 - RNA, 24 nt, Zea mays
ccagauggugaugcgaguugacac

SEQ ID NO: 5555 - RNA, 21 nt, Zea mays
ugcaagcaguccuucugugca

SEQ ID NO: 5556 - RNA, 21 nt, Zea mays
cgccugcgccgcaccgacugc

SEQ ID NO: 5557 - RNA, 24 nt, Zea mays
acccaucggguuucggguuucggg

SEQ ID NO: 5558 - RNA, 22 nt, Zea mays
agaaggguacaacauguugggg

SEQ ID NO: 5559 - RNA, 22 nt, Zea mays
gugaugccggaugucuaugugc

SEQ ID NO: 5560 - RNA, 24 nt, Zea mays
ccggacaguccggugcacccagac

SEQ ID NO: 5561 - RNA, 24 nt, Zea mays
ugccagcgacauaacacucggcaa

SEQ ID NO: 5562 - RNA, 22 nt, Zea mays
gccgaagcugccuucuccgugg

SEQ ID NO: 5563 - RNA, 21 nt, Zea mays
ugaauugaccuaacgugccuc

SEQ ID NO: 5564 - RNA, 24 nt, Zea mays
guggcaggcgagcgggcguggugu

SEQ ID NO: 5565 - RNA, 20 nt, Zea mays
aauacccagcagccacacca

SEQ ID NO: 5566 - RNA, 24 nt, Zea mays
gaucgaacgauccuugugcuagug

SEQ ID NO: 5567 - RNA, 24 nt, Zea mays
gacuaauaaaaagaaacggaggga

SEQ ID NO: 5568 - RNA, 21 nt, Zea mays
uguguucucaggucgcccccg

SEQ ID NO: 5569 - RNA, 21 nt, Zea mays
cgccggguugcugccguggcc

SEQ ID NO: 5570 - RNA, 21 nt, Zea mays
uccacaggcuuucuugaacug

SEQ ID NO: 5571 - RNA, 22 nt, Zea mays
ccgacucauccgagcccucgag

SEQ ID NO: 5572 - RNA, 24 nt, Zea mays
acggucggcugacguggcgugcac

SEQ ID NO: 5573 - RNA, 24 nt, Zea mays
uccgauacccgcccgauacccgau

SEQ ID NO: 5574 - RNA, 21 nt, Zea mays
guugggcugcggaacuacaaa

SEQ ID NO: 5575 - RNA, 24 nt, Zea mays
gccgcaagggcccggacgguccgc

SEQ ID NO: 5576 - RNA, 21 nt, Zea mays
cgcucuugcuugcggugccga

SEQ ID NO: 5577 - RNA, 24 nt, Zea mays
ugcucucaggauagccggcagggu

SEQ ID NO: 5578 - RNA, 24 nt, Zea mays
cgggagauggcaagaagcuucgga

SEQ ID NO: 5579 - RNA, 22 nt, Zea mays
ucaaacacaacgucacaagaaa

SEQ ID NO: 5580 - RNA, 24 nt, Zea mays
ccaguuaaaggguccucggucagc

SEQ ID NO: 5581 - RNA, 24 nt, Zea mays
aauccgacggaaacgaacaaggcc

SEQ ID NO: 5582 - RNA, 24 nt, Zea mays
acagccugcacagacugaagaugu

SEQ ID NO: 5583 - RNA, 21 nt, Zea mays
ucuaaaaugaguggugaugau

SEQ ID NO: 5584 - RNA, 24 nt, Zea mays
aaggcuuagcugcaguguaucagu

SEQ ID NO: 5585 - RNA, 20 nt, Zea mays
gucaggccggucaguggagc

SEQ ID NO: 5586 - RNA, 21 nt, Zea mays
cgcgcagcgcguggcggcgga

SEQ ID NO: 5587 - RNA, 24 nt, Zea mays
gcugacucaggcgaacuugcugcu

SEQ ID NO: 5588 - RNA, 24 nt, Zea mays
ugcaaccacugcucaggcgaagau

SEQ ID NO: 5589 - RNA, 24 nt, Zea mays
agccgacagagccgaagugaccgc

SEQ ID NO: 5590 - RNA, 24 nt, Zea mays
guggcagguugggcuucaggugga

SEQ ID NO: 5591 - RNA, 24 nt, Zea mays
ccgagggauccaccgguucauguc

SEQ ID NO: 5592 - RNA, 22 nt, Zea mays
ucuggguuggccacucuccgaa

SEQ ID NO: 5593 - RNA, 24 nt, Zea mays
gugcuuaaauccauacucguuguc

SEQ ID NO: 5594 - RNA, 21 nt, Zea mays
aacacaagggcauauagaguc

SEQ ID NO: 5595 - RNA, 24 nt, Zea mays
ccucgccggacuucggucgcccgc

SEQ ID NO: 5596 - RNA, 24 nt, Zea mays
accuauggauuggacgggauugga

SEQ ID NO: 5597 - RNA, 24 nt, Zea mays
gaagcaacaguaucuucguauggu

SEQ ID NO: 5598 - RNA, 22 nt, Zea mays
ccgagaagcuacccaggcacag

SEQ ID NO: 5599 - RNA, 24 nt, Zea mays
ugcagcccaccaggaacacgccgg

SEQ ID NO: 5600 - RNA, 20 nt, Zea mays
ugacagaagagagugagcac

SEQ ID NO: 5601 - RNA, 24 nt, Zea mays
augcugagagggcacgucgcccgu

SEQ ID NO: 5602 - RNA, 22 nt, Zea mays
ucaagauaugcccaaggaaggc

SEQ ID NO: 5603 - RNA, 21 nt, Zea mays
ugauugagccgugccaauauc

SEQ ID NO: 5604 - RNA, 21 nt, Zea mays
agaaucuugaugaugcugcau

SEQ ID NO: 5605 - RNA, 21 nt, Zea mays
gcgccaggucguggaccgucc

SEQ ID NO: 5606 - RNA, 23 nt, Zea mays
ccggcugguuggcguuggcgggc

SEQ ID NO: 5607 - RNA, 24 nt, Zea mays
uguccugaucgagagcgauggagc

SEQ ID NO: 5608 - RNA, 21 nt, Zea mays
ugguuucgcgcaauuucguug

SEQ ID NO: 5609 - RNA, 24 nt, Zea mays
gaaggacucggcaagcgacgacgc

SEQ ID NO: 5610 - RNA, 21 nt, Zea mays
caauccauauggauuggggua

SEQ ID NO: 5611 - RNA, 23 nt, Zea mays
cggcuggugcaccugggacgccu

SEQ ID NO: 5612 - RNA, 22 nt, Zea mays
caccagaggcgguucggcggcg

SEQ ID NO: 5613 - RNA, 24 nt, Zea mays
gaaaacgguacgguaaacggugag

SEQ ID NO: 5614 - RNA, 21 nt, Zea mays
caggggggcggccuguccgag

SEQ ID NO: 5615 - RNA, 21 nt, Zea mays
ccggaggcuccggaagugccg

SEQ ID NO: 5616 - RNA, 21 nt, Zea mays
uguauuggagugaauacuaga

SEQ ID NO: 5617 - RNA, 22 nt, Zea mays
ccuuagccuuaucucgucgguc

SEQ ID NO: 5618 - RNA, 24 nt, Zea mays
ccgcgggagcuagcugugguccga

SEQ ID NO: 5619 - RNA, 24 nt, Zea mays
gagcggcggacgguccggcccuga

SEQ ID NO: 5620 - RNA, 20 nt, Zea mays
aggccaucgucaccggcaag

SEQ ID NO: 5621 - RNA, 22 nt, Zea mays
gaccuggugcuucggcugcggc

SEQ ID NO: 5622 - RNA, 24 nt, Zea mays
cggguguaauccgaugcaaacgaa

SEQ ID NO: 5623 - RNA, 21 nt, Zea mays
ggucgcuauagaugucgucgg

SEQ ID NO: 5624 - RNA, 21 nt, Zea mays
uguccaaccacgaugcauguc

SEQ ID NO: 5625 - RNA, 21 nt, Zea mays
cgcggcggcgcuuaacaagau

SEQ ID NO: 5626 - RNA, 24 nt, Zea mays
agcugcucguuagguuucgccagu

SEQ ID NO: 5627 - RNA, 23 nt, Zea mays
ucaacagagcccaaaacuugguc

SEQ ID NO: 5628 - RNA, 24 nt, Zea mays
auuccagcugaacguauggaugac

SEQ ID NO: 5629 - RNA, 23 nt, Zea mays
cgcuacgggcagcaccacagcgc

SEQ ID NO: 5630 - RNA, 22 nt, Zea mays
gaguugaacuaugacgaguggg

SEQ ID NO: 5631 - RNA, 22 nt, Zea mays
uacguguacauugcauccaucu

SEQ ID NO: 5632 - RNA, 20 nt, Zea mays
ccgccuucuucgcgcacguc

SEQ ID NO: 5633 - RNA, 20 nt, Zea mays
ggccuugccgacuuugaagc

SEQ ID NO: 5634 - RNA, 20 nt, Zea mays
ccgggaugcagcccacacgu

SEQ ID NO: 5635 - RNA, 20 nt, Zea mays
agcuucacgggcuacuggcg

SEQ ID NO: 5636 - RNA, 24 nt, Zea mays
cggcccggacuucgacaacgcggg

SEQ ID NO: 5637 - RNA, 23 nt, Zea mays
ucuggucgcugggauuuucgguc

SEQ ID NO: 5638 - RNA, 21 nt, Zea mays
cgcagaucgagauccucgccg

SEQ ID NO: 5639 - RNA, 20 nt, Zea mays
uguguggccuuguauuugug

SEQ ID NO: 5640 - RNA, 24 nt, Zea mays
accacuaauacaagggccaagugc

SEQ ID NO: 5641 - RNA, 20 nt, Zea mays
gguccggccguucuaagaga

SEQ ID NO: 5642 - RNA, 24 nt, Zea mays
cucaagccuagcuaugggugcaua

SEQ ID NO: 5643 - RNA, 22 nt, Zea mays
gcgguucaaggagucggaggug

SEQ ID NO: 5644 - RNA, 23 nt, Zea mays
gcucgagcuguguguccugaccc

SEQ ID NO: 5645 - RNA, 23 nt, Zea mays
ccggacgccuaggcgacgccuua

SEQ ID NO: 5646 - RNA, 23 nt, Zea mays
cugguguggccgggccucugguu

SEQ ID NO: 5647 - RNA, 22 nt, Zea mays
guggcgagggugaagacgucgg

SEQ ID NO: 5648 - RNA, 24 nt, Zea mays
cggcagagccgaagugaccgccgu

SEQ ID NO: 5649 - RNA, 24 nt, Zea mays
agcuuugugcugauagggguuacc

SEQ ID NO: 5650 - RNA, 24 nt, Zea mays
acugccugaucgguggugacgacu

SEQ ID NO: 5651 - RNA, 23 nt, Zea mays
ugauaugccuuggguggaccaac

SEQ ID NO: 5652 - RNA, 24 nt, Zea mays
gcagcaggcggggaguggaugcgc

SEQ ID NO: 5653 - RNA, 20 nt, Zea mays
ggacuguccggugcaccacc

SEQ ID NO: 5654 - RNA, 24 nt, Zea mays
agagccaacugcuggcacucggca

SEQ ID NO: 5655 - RNA, 23 nt, Zea mays
uggcgaagcuagaguaaaauaga

SEQ ID NO: 5656 - RNA, 21 nt, Zea mays
ggcuagcuaggugguccucga

SEQ ID NO: 5657 - RNA, 20 nt, Zea mays
gggucuugaaguggucauca

SEQ ID NO: 5658 - RNA, 24 nt, Zea mays
gccauucugcgaucugcaugguuc

SEQ ID NO: 5659 - RNA, 24 nt, Zea mays
gccgauaaccuguuucgaggcgcc

SEQ ID NO: 5660 - RNA, 21 nt, Zea mays
ugccugacccugcuuauucga

SEQ ID NO: 5661 - RNA, 21 nt, Zea mays
gaacuaaaauagaauaaagug

SEQ ID NO: 5662 - RNA, 24 nt, Zea mays
ggcucaggcuccgcgacggccgcc

SEQ ID NO: 5663 - RNA, 22 nt, Zea mays
uggaaggggcaugcagaggagc

SEQ ID NO: 5664 - RNA, 24 nt, Zea mays
caccgccgugagcccgcugcugcg

SEQ ID NO: 5665 - RNA, 20 nt, Zea mays
ucgggcaccggacacugucc

SEQ ID NO: 5666 - RNA, 22 nt, Zea mays
gacaaagcuagcuguuggugau

SEQ ID NO: 5667 - RNA, 24 nt, Zea mays
gcgaccaugaacgcgugcuggcgu

SEQ ID NO: 5668 - RNA, 22 nt, Zea mays
gacuucuuguauugucucccug

SEQ ID NO: 5669 - RNA, 21 nt, Zea mays
cgguguacaccggacuguccg

SEQ ID NO: 5670 - RNA, 21 nt, Zea mays
agcccauuggauggacuuguu

SEQ ID NO: 5671 - RNA, 24 nt, Zea mays
agcgaucgggccgggauggaugag

SEQ ID NO: 5672 - RNA, 20 nt, Zea mays
guggaggcggagguggcgau

SEQ ID NO: 5673 - RNA, 20 nt, Zea mays
uuggcacaaaauucaguagg

SEQ ID NO: 5674 - RNA, 20 nt, Zea mays
guccauggggucugcagagu

SEQ ID NO: 5675 - RNA, 22 nt, Zea mays
ugcgcagccaaucuucagcauc

SEQ ID NO: 5676 - RNA, 24 nt, Zea mays
gaugcugugaacuguugcagaggc

SEQ ID NO: 5677 - RNA, 22 nt, Zea mays
ggcuggaguucagcgagugcau

SEQ ID NO: 5678 - RNA, 25 nt, Zea mays
cgccgaggugagggaacucguggag

SEQ ID NO: 5679 - RNA, 20 nt, Zea mays
aguaccaucgcuuugccgcu

SEQ ID NO: 5680 - RNA, 24 nt, Zea mays
gcaccguguugguagucgagcgag

SEQ ID NO: 5681 - RNA, 21 nt, Zea mays
caccgcaguccgggcacuccu

SEQ ID NO: 5682 - RNA, 22 nt, Zea mays
gggguguuugguuagagggacu

SEQ ID NO: 5683 - RNA, 21 nt, Zea mays
acgauccuugugcuagugugu

SEQ ID NO: 5684 - RNA, 24 nt, Zea mays
ggaguuggagccaugcuaaacagg

SEQ ID NO: 5685 - RNA, 24 nt, Zea mays
gccaucaagagcgacgccgagauc

SEQ ID NO: 5686 - RNA, 24 nt, Zea mays
ucauugcaggagcagacuugagug

SEQ ID NO: 5687 - RNA, 21 nt, Zea mays
cgucuccauggucguccgcgc

SEQ ID NO: 5688 - RNA, 21 nt, Zea mays
ggccgucagggcgcucauggg

SEQ ID NO: 5689 - RNA, 24 nt, Zea mays
gucuugggcgguccucccgugcgc

SEQ ID NO: 5690 - RNA, 21 nt, Zea mays
uagaccacucacgaacucauc

SEQ ID NO: 5691 - RNA, 24 nt, Zea mays
agccgccucggccgcacugcuacc

SEQ ID NO: 5692 - RNA, 23 nt, Zea mays
gacuccugcgaggaagaggcuga

SEQ ID NO: 5693 - RNA, 24 nt, Zea mays
gcgcauguuugguugccugcacgu

SEQ ID NO: 5694 - RNA, 21 nt, Zea mays
uccgcaaggccacugccaccg

SEQ ID NO: 5695 - RNA, 22 nt, Zea mays
ucggacuguccggugugcaccg

SEQ ID NO: 5696 - RNA, 20 nt, Zea mays
gacccucaugagcacaucgg

SEQ ID NO: 5697 - RNA, 22 nt, Zea mays
ucggcaccagacgaagaccggc

SEQ ID NO: 5698 - RNA, 25 nt, Zea mays
ugaggagcugaucccagaguggcug

SEQ ID NO: 5699 - RNA, 21 nt, Zea mays
cuucaccaccggcaucgucgu

SEQ ID NO: 5700 - RNA, 24 nt, Zea mays
gcggaguccauucaguucagcgua

SEQ ID NO: 5701 - RNA, 20 nt, Zea mays
ggaugagauucuaagcaagu

SEQ ID NO: 5702 - RNA, 24 nt, Zea mays
aacauccacgcccagauccagugc

SEQ ID NO: 5703 - RNA, 22 nt, Zea mays
gcugaugacaggccugaauugu

SEQ ID NO: 5704 - RNA, 24 nt, Zea mays
acagccuccugcagucgcguuguc

SEQ ID NO: 5705 - RNA, 21 nt, Zea mays
ggggacgccgccgcuugcccg

SEQ ID NO: 5706 - RNA, 21 nt, Zea mays
ccugaguccgagcccuggggu

SEQ ID NO: 5707 - RNA, 22 nt, Zea mays
uauccaggccuaucaaacccuc

SEQ ID NO: 5708 - RNA, 24 nt, Zea mays
gcaccggcagguccucacucccgu

SEQ ID NO: 5709 - RNA, 21 nt, Zea mays
ucacaaaaaggaggauagacc

SEQ ID NO: 5710 - RNA, 23 nt, Zea mays
gaguacguagucgcgaagcauaa

SEQ ID NO: 5711 - RNA, 21 nt, Zea mays
gccggaaucgcucgguccacg

SEQ ID NO: 5712 - RNA, 24 nt, Zea mays
aaucuccucgggcgucaucuuggu

SEQ ID NO: 5713 - RNA, 21 nt, Zea mays
ccaccgccacugccgucucga

SEQ ID NO: 5714 - RNA, 24 nt, Zea mays
gaauugugcaaaggcuaaggcgau

SEQ ID NO: 5715 - RNA, 24 nt, Zea mays
ccacauggauugagugggauuggg

SEQ ID NO: 5716 - RNA, 23 nt, Zea mays
cacgucugccugggcgucacgca

SEQ ID NO: 5717 - RNA, 25 nt, Zea mays
ugccacgccaccgucguuucaggau

SEQ ID NO: 5718 - RNA, 21 nt, Zea mays
cggcgucgagcaccgcgguga

SEQ ID NO: 5719 - RNA, 21 nt, Zea mays
ggcuacaagcucgggacugcc

SEQ ID NO: 5720 - RNA, 21 nt, Zea mays
gccuggucugcccucgaucug

SEQ ID NO: 5721 - RNA, 21 nt, Zea mays
ggaccguuucccugauuccuu

SEQ ID NO: 5722 - RNA, 21 nt, Zea mays
gagcccagccgacgccgagcc

SEQ ID NO: 5723 - RNA, 20 nt, Zea mays
ggacaguccggugugccaga

SEQ ID NO: 5724 - RNA, 22 nt, Zea mays
accugaugguugguggugagug

SEQ ID NO: 5725 - RNA, 22 nt, Zea mays
ccacacgguacggagcggcggc

SEQ ID NO: 5726 - RNA, 22 nt, Zea mays
gaucauguucaguucuccuaau

SEQ ID NO: 5727 - RNA, 24 nt, Zea mays
cacucagcagcaggcucacuuggc

SEQ ID NO: 5728 - RNA, 23 nt, Zea mays
aggacccuauguccuuguguguu

SEQ ID NO: 5729 - RNA, 24 nt, Zea mays
gauaaugggccuuggacgaagguu

SEQ ID NO: 5730 - RNA, 23 nt, Zea mays
ugcgggcgggucggacuucgaca

SEQ ID NO: 5731 - RNA, 23 nt, Zea mays
gcugcaagccgaccaccggcguc

SEQ ID NO: 5732 - RNA, 20 nt, Zea mays
agaggcacgcuuugccgagu

SEQ ID NO: 5733 - RNA, 24 nt, Zea mays
aagucuuggugaccugguccggcc

SEQ ID NO: 5734 - RNA, 20 nt, Zea mays
ucgcgccgcgggugcucagc

SEQ ID NO: 5735 - RNA, 20 nt, Zea mays
gccguccagcaggugugccu

SEQ ID NO: 5736 - RNA, 23 nt, Zea mays
cgaugcgugcagcggcugaagga

SEQ ID NO: 5737 - RNA, 24 nt, Zea mays
ggaccuucacgggagaguaccgga

SEQ ID NO: 5738 - RNA, 22 nt, Zea mays
ucacucgauggugagucacaga

SEQ ID NO: 5739 - RNA, 22 nt, Zea mays
uccgcagguacgaacgacccca

SEQ ID NO: 5740 - RNA, 23 nt, Zea mays
cgccuaggcgacgccuuaagaac

SEQ ID NO: 5741 - RNA, 24 nt, Zea mays
gaaggccucagacauugcuggaau

SEQ ID NO: 5742 - RNA, 22 nt, Zea mays
ggcuuggcguugcugcucgauc

SEQ ID NO: 5743 - RNA, 24 nt, Zea mays
uauuauaugucuccguugcaacgc

SEQ ID NO: 5744 - RNA, 23 nt, Zea mays
uugcguauguugggucuacuggu

SEQ ID NO: 5745 - RNA, 24 nt, Zea mays
gacaaagaaccugacaaagggccc

SEQ ID NO: 5746 - RNA, 21 nt, Zea mays
aguuguggcgcagaauuugag

SEQ ID NO: 5747 - RNA, 21 nt, Zea mays
ugagcggaucgagauggcggc

SEQ ID NO: 5748 - RNA, 24 nt, Zea mays
gucacugcgcgcgggcccugucgc

SEQ ID NO: 5749 - RNA, 21 nt, Zea mays
aagccaaaacaacuuacaauu

SEQ ID NO: 5750 - RNA, 21 nt, Zea mays
uaugcaagcagguacuaggug

SEQ ID NO: 5751 - RNA, 22 nt, Zea mays
cuucugcagcaguauggcuuga

SEQ ID NO: 5752 - RNA, 24 nt, Zea mays
gcaccgcagcugcgccacguucgc

SEQ ID NO: 5753 - RNA, 21 nt, Zea mays
uucuacagccaggaugauguc

SEQ ID NO: 5754 - RNA, 22 nt, Zea mays
ggguugcuggaccauugucucc

SEQ ID NO: 5755 - RNA, 21 nt, Zea mays
ugcggaggcgcggacgguccg

SEQ ID NO: 5756 - RNA, 24 nt, Zea mays
ccucccgcgcggccaccuucucgu

SEQ ID NO: 5757 - RNA, 24 nt, Zea mays
ccagcguccgcgccgaccuccgcc

SEQ ID NO: 5758 - RNA, 20 nt, Zea mays
ugcacugcagcugcuucguc

SEQ ID NO: 5759 - RNA, 22 nt, Zea mays
acggcgcugacaugucugaagu

SEQ ID NO: 5760 - RNA, 24 nt, Zea mays
ggagaggcugacccacgaacccgc

SEQ ID NO: 5761 - RNA, 20 nt, Zea mays
ucgacgucgacgccaacggg

SEQ ID NO: 5762 - RNA, 24 nt, Zea mays
cugcauuaggugauaggaguugug

SEQ ID NO: 5763 - RNA, 23 nt, Zea mays
ccguuagugaugggggccagggu

SEQ ID NO: 5764 - RNA, 23 nt, Zea mays
uagugacgaggaaugcugugugc

SEQ ID NO: 5765 - RNA, 22 nt, Zea mays
gguaggaggucuaguucugucc

SEQ ID NO: 5766 - RNA, 22 nt, Zea mays
acgcgaggucgacgcccgacau

SEQ ID NO: 5767 - RNA, 21 nt, Zea mays
gacccuggcggcgauggcccg

SEQ ID NO: 5768 - RNA, 20 nt, Zea mays
ggaggcagcggugucagcgu

SEQ ID NO: 5769 - RNA, 21 nt, Zea mays
gaugagaaguugucaggcguc

SEQ ID NO: 5770 - RNA, 21 nt, Zea mays
ucauggccggugaugaggagg

SEQ ID NO: 5771 - RNA, 24 nt, Zea mays
cucugcgcccuuccauccauggcc

SEQ ID NO: 5772 - RNA, 22 nt, Zea mays
aggaggagucgcuccugcgcca

SEQ ID NO: 5773 - RNA, 24 nt, Zea mays
cguggccgaggucgaguccgagcc

SEQ ID NO: 5774 - RNA, 24 nt, Zea mays
cgucaccgggaagggcccgcucga

SEQ ID NO: 5775 - RNA, 22 nt, Zea mays
gagauguaugcuugcuggccag

SEQ ID NO: 5776 - RNA, 24 nt, Zea mays
cacgccgcggcagcagccaagccu

SEQ ID NO: 5777 - RNA, 22 nt, Zea mays
cauguggauuggaugggauugg

SEQ ID NO: 5778 - RNA, 20 nt, Zea mays
gugugcaccagacauguccg

SEQ ID NO: 5779 - RNA, 24 nt, Zea mays
cuugccgacugaggcacgcguguc

SEQ ID NO: 5780 - RNA, 24 nt, Zea mays
ugagggaggcgucgcagcagcugu

SEQ ID NO: 5781 - RNA, 21 nt, Zea mays
uggcaggggugguucaauagu

SEQ ID NO: 5782 - RNA, 21 nt, Zea mays
ucucgaugcaugcuacacguc

SEQ ID NO: 5783 - RNA, 20 nt, Zea mays
cagacuguccggugugccac

SEQ ID NO: 5784 - RNA, 20 nt, Zea mays
aggaaacuugaaaggguagu

SEQ ID NO: 5785 - RNA, 24 nt, Zea mays
uccccgaggacgagggccuacacc

SEQ ID NO: 5786 - RNA, 21 nt, Zea mays
cagcaggaugaugccucaguc

SEQ ID NO: 5787 - RNA, 21 nt, Zea mays
gaguucgucgucuuccggggc

SEQ ID NO: 5788 - RNA, 22 nt, Zea mays
uggacaagcagcucguccucga

SEQ ID NO: 5789 - RNA, 22 nt, Zea mays
gagccuaacguggauugcccug

SEQ ID NO: 5790 - RNA, 22 nt, Zea mays
caucaacuugagcuucauccuc

SEQ ID NO: 5791 - RNA, 24 nt, Zea mays
gaccacaacagggcucuuggccag

SEQ ID NO: 5792 - RNA, 25 nt, Zea mays
cggcaucuccggcgugcucugggcc

SEQ ID NO: 5793 - RNA, 23 nt, Zea mays
aggacacgacgaagaccugggca

SEQ ID NO: 5794 - RNA, 24 nt, Zea mays
cgacgucgagacacuuggaguaga

SEQ ID NO: 5795 - RNA, 21 nt, Zea mays
agucacgcuccguuccguuca

SEQ ID NO: 5796 - RNA, 24 nt, Zea mays
cggcagcagguggcagccacugug

SEQ ID NO: 5797 - RNA, 21 nt, Zea mays
cccuacagcgagguguucggc

SEQ ID NO: 5798 - RNA, 22 nt, Zea mays
ucaaaccaagucauagguguau

SEQ ID NO: 5799 - RNA, 22 nt, Zea mays
ugagcagaacuacccuacacau

SEQ ID NO: 5800 - RNA, 21 nt, Zea mays
ucgccacgcucgaggucgucc

SEQ ID NO: 5801 - RNA, 21 nt, Zea mays
cgggcccagaugagugacugc

SEQ ID NO: 5802 - RNA, 22 nt, Zea mays
cgccgucgcacgccagaucauc

SEQ ID NO: 5803 - RNA, 21 nt, Zea mays
agccaacugcugcucagucug

SEQ ID NO: 5804 - RNA, 24 nt, Zea mays
ugaccuccaacucuacggccuucu

SEQ ID NO: 5805 - RNA, 24 nt, Zea mays
ggcccucgaaggccuaguccccgu

SEQ ID NO: 5806 - RNA, 24 nt, Zea mays
caccggacagguccuguagacggu

SEQ ID NO: 5807 - RNA, 24 nt, Zea mays
gcucacacgcgacaacuacuccga

SEQ ID NO: 5808 - RNA, 22 nt, Zea mays
cggugcuugugagguccgguca

SEQ ID NO: 5809 - RNA, 24 nt, Zea mays
ugacacacccccuaccuggcgcgc

SEQ ID NO: 5810 - RNA, 24 nt, Zea mays
accauccaugcggucaucaguguc

SEQ ID NO: 5811 - RNA, 22 nt, Zea mays
gcaagggauuccugggaaggcc

SEQ ID NO: 5812 - RNA, 21 nt, Zea mays
cugaagacgucgucgaugccg

SEQ ID NO: 5813 - RNA, 21 nt, Zea mays
cccgcgcggccggauccuugg

SEQ ID NO: 5814 - RNA, 20 nt, Zea mays
caagggggugcuacagccag

SEQ ID NO: 5815 - RNA, 22 nt, Zea mays
cuagaugcaugugcccagacug

SEQ ID NO: 5816 - RNA, 21 nt, Zea mays
ccugcaccgccgaguucuccg

SEQ ID NO: 5817 - RNA, 20 nt, Zea mays
acucgaucgaccaggugugc

SEQ ID NO: 5818 - RNA, 20 nt, Zea mays
accuguauaucauggagagc

SEQ ID NO: 5819 - RNA, 21 nt, Zea mays
uccaacgaggacuaggcaagc

SEQ ID NO: 5820 - RNA, 20 nt, Zea mays
caagaugcuggaccggggca

SEQ ID NO: 5821 - RNA, 20 nt, Zea mays
gcugugcuugcuuguugguu

SEQ ID NO: 5822 - RNA, 20 nt, Zea mays
gguccggacucacuggugau

SEQ ID NO: 5823 - RNA, 21 nt, Zea mays
gcgauguccaaggcugcgugc

SEQ ID NO: 5824 - RNA, 24 nt, Zea mays
gcgcagugaacagcacgccgucga

SEQ ID NO: 5825 - RNA, 20 nt, Zea mays
uuuccacaggcuuucuugaa

SEQ ID NO: 5826 - RNA, 24 nt, Zea mays
ggaaacuuaggacagaaucgccuc

SEQ ID NO: 5827 - RNA, 20 nt, Zea mays
gggcaauacgucguaccagg

SEQ ID NO: 5828 - RNA, 23 nt, Zea mays
gagcccgccgccgacgcgcccgc

SEQ ID NO: 5829 - RNA, 23 nt, Zea mays
ugcaagaauccucggacgaagug

SEQ ID NO: 5830 - RNA, 21 nt, Zea mays
cgaccagcgcggcagccagca

SEQ ID NO: 5831 - RNA, 20 nt, Zea mays
uuugccgagagcaggacucu

SEQ ID NO: 5832 - RNA, 24 nt, Zea mays
cgcaguccuugacgcaguagucgc

SEQ ID NO: 5833 - RNA, 22 nt, Zea mays
ccacuccgacugcagugccacu

SEQ ID NO: 5834 - RNA, 20 nt, Zea mays
acggcugcaacuguuccgcg

SEQ ID NO: 5835 - RNA, 22 nt, Zea mays
gugcgggagcugcaggacgcga

SEQ ID NO: 5836 - RNA, 23 nt, Zea mays
ccgccggggcagccugcguucuu

SEQ ID NO: 5837 - RNA, 24 nt, Zea mays
cggccagggccaacggucggccgc

SEQ ID NO: 5838 - RNA, 20 nt, Zea mays
cccagccugauccacgcgca

SEQ ID NO: 5839 - RNA, 22 nt, Zea mays
ccuccguucucgaauauuuauc

SEQ ID NO: 5840 - RNA, 21 nt, Zea mays
gacugcggcggaggccucgag

SEQ ID NO: 5841 - RNA, 24 nt, Zea mays
cgaggccaugagccgggcugaugu

SEQ ID NO: 5842 - RNA, 20 nt, Zea mays
gggugcuguacucucggaaa

SEQ ID NO: 5843 - RNA, 24 nt, Zea mays
uccucgaacaagggguggcagcgc

SEQ ID NO: 5844 - RNA, 24 nt, Zea mays
cucugguccgacagccgacgaggu

SEQ ID NO: 5845 - RNA, 22 nt, Zea mays
gucggguaugauaucgggucgg

SEQ ID NO: 5846 - RNA, 20 nt, Zea mays
gccuggccgacgaccccgag

SEQ ID NO: 5847 - RNA, 24 nt, Zea mays
cgacccgcugggccucgccgacga

SEQ ID NO: 5848 - RNA, 21 nt, Zea mays
gcgguggcuaaguccugugug

SEQ ID NO: 5849 - RNA, 24 nt, Zea mays
cgcacggcucggucuugcugcccu

SEQ ID NO: 5850 - RNA, 21 nt, Zea mays
gggagaauccacuugccuugc

SEQ ID NO: 5851 - RNA, 24 nt, Zea mays
gccuguuccacuacagaucgguuc

SEQ ID NO: 5852 - RNA, 22 nt, Zea mays
ccaggacuuguguggcaccacu

SEQ ID NO: 5853 - RNA, 21 nt, Zea mays
cagccaaggaugacuugccga

SEQ ID NO: 5854 - RNA, 22 nt, Zea mays
gcgccucgaggaggaagcggcc

SEQ ID NO: 5855 - RNA, 21 nt, Zea mays
ugugccagaagcggcgauggg

SEQ ID NO: 5856 - RNA, 22 nt, Zea mays
cacucggucggcggcuguccgg

SEQ ID NO: 5857 - RNA, 24 nt, Zea mays
gaugucagggucaggccgccgccc

SEQ ID NO: 5858 - RNA, 24 nt, Zea mays
ggcauugcgucgaacaggucccgc

SEQ ID NO: 5859 - RNA, 24 nt, Zea mays
agacauguguugcugacuugcugu

SEQ ID NO: 5860 - RNA, 23 nt, Zea mays
cagagccugagaaccagauugcu

SEQ ID NO: 5861 - RNA, 21 nt, Zea mays
ucuccaaacuggcaccuccga

SEQ ID NO: 5862 - RNA, 23 nt, Zea mays
gcucuccagguguucgguuaaug

SEQ ID NO: 5863 - RNA, 24 nt, Zea mays
gaucaauccaaggggugcgacaga

SEQ ID NO: 5864 - RNA, 23 nt, Zea mays
gcaaggugaacucaagcuucgug

SEQ ID NO: 5865 - RNA, 20 nt, Zea mays
guagcugagggcacaugcgu

SEQ ID NO: 5866 - RNA, 23 nt, Zea mays
cgacgcagaugauccugcaaugu

SEQ ID NO: 5867 - RNA, 20 nt, Zea mays
gcuccacggugucguuguca

SEQ ID NO: 5868 - RNA, 24 nt, Zea mays
cccugcgagaguacauccgacggu

SEQ ID NO: 5869 - RNA, 22 nt, Zea mays
caaucccacccaauacacucca

SEQ ID NO: 5870 - RNA, 21 nt, Zea mays
gucgcugauuguagcucgaug

SEQ ID NO: 5871 - RNA, 21 nt, Zea mays
cggagccguccacgugguggg

SEQ ID NO: 5872 - RNA, 20 nt, Zea mays
cggugagcgcagcgccgggg

SEQ ID NO: 5873 - RNA, 24 nt, Zea mays
aggguagcgaugaacuaacagcgu

SEQ ID NO: 5874 - RNA, 24 nt, Zea mays
gcaacccgagccugauccacgcgc

SEQ ID NO: 5875 - RNA, 23 nt, Zea mays
acaucgacgccaugguuaucaac

SEQ ID NO: 5876 - RNA, 20 nt, Zea mays
ucgcgagauuggaacagggc

SEQ ID NO: 5877 - RNA, 25 nt, Zea mays
caaagacaaugucugcugauccagu

SEQ ID NO: 5878 - RNA, 22 nt, Zea mays
gagguucgcgagccggaucgag

SEQ ID NO: 5879 - RNA, 20 nt, Zea mays
cgccgcgcaaaaucgcccgu

SEQ ID NO: 5880 - RNA, 24 nt, Zea mays
gagccaaacgccagaucagcgggg

SEQ ID NO: 5881 - RNA, 21 nt, Zea mays
gaccaacgacugggaggagca

SEQ ID NO: 5882 - RNA, 20 nt, Zea mays
cgacgcgcaggagccgacgg

SEQ ID NO: 5883 - RNA, 20 nt, Zea mays
ggccucggcagcuuggcucc

SEQ ID NO: 5884 - RNA, 22 nt, Zea mays
cggcgcuggauacuggcugaac

SEQ ID NO: 5885 - RNA, 22 nt, Zea mays
guacugugagccaagcgaugug

SEQ ID NO: 5886 - RNA, 21 nt, Zea mays
augagacucuuguggcccaga

SEQ ID NO: 5887 - RNA, 21 nt, Zea mays
caccuccgaccacaccuuggc

SEQ ID NO: 5888 - RNA, 20 nt, Zea mays
caaccagcuacuucugacaa

SEQ ID NO: 5889 - RNA, 21 nt, Zea mays
ggcccgcacucguuccugcag

SEQ ID NO: 5890 - RNA, 21 nt, Zea mays
uggcgucggccaccgagcugc

SEQ ID NO: 5891 - RNA, 21 nt, Zea mays
cugcgccgacgccgaggccca

SEQ ID NO: 5892 - RNA, 24 nt, Zea mays
cgccgccgccugugugccgagcgc

SEQ ID NO: 5893 - RNA, 21 nt, Zea mays
guccuccccuacaaguccgag

SEQ ID NO: 5894 - RNA, 20 nt, Zea mays
gcgcgagauggaacacaagg

SEQ ID NO: 5895 - RNA, 24 nt, Zea mays
ggguuguaggugacgucggacguc

SEQ ID NO: 5896 - RNA, 23 nt, Zea mays
ccagccaugcgggggaaggcgaa

SEQ ID NO: 5897 - RNA, 20 nt, Zea mays
cccgaaaucaucuacugcga

SEQ ID NO: 5898 - RNA, 22 nt, Zea mays
agacauguccagugugcaccgg

SEQ ID NO: 5899 - RNA, 22 nt, Zea mays
uggcuguguagagaaucugagu

SEQ ID NO: 5900 - RNA, 24 nt, Zea mays
acgcagggucucaucuuuguugug

SEQ ID NO: 5901 - RNA, 24 nt, Zea mays
cgagggcauccugcugaagccguc

SEQ ID NO: 5902 - RNA, 21 nt, Zea mays
ccucgccaagcuagccuagau

SEQ ID NO: 5903 - RNA, 25 nt, Zea mays
ggccacucucagugaaggcggcgau

SEQ ID NO: 5904 - RNA, 22 nt, Zea mays
caagaaguggaugcucaagcag

SEQ ID NO: 5905 - RNA, 24 nt, Zea mays
gggucgggcuuugcugaagacguc

SEQ ID NO: 5906 - RNA, 24 nt, Zea mays
gcauccuacgguuccuacuugcaa

SEQ ID NO: 5907 - RNA, 25 nt, Zea mays
gcaggagggcacaggaaggaggaga

SEQ ID NO: 5908 - RNA, 23 nt, Zea mays
cgccgcaccacgucgucuccaag

SEQ ID NO: 5909 - RNA, 24 nt, Zea mays
ggagguccagcgccaccacguguc

SEQ ID NO: 5910 - RNA, 24 nt, Zea mays
uagcucuaucugaucaucuccuug

SEQ ID NO: 5911 - RNA, 24 nt, Zea mays
guccaguuccucuugcucagcagu

SEQ ID NO: 5912 - RNA, 21 nt, Zea mays
ugcauuaggugauaggaguug

SEQ ID NO: 5913 - RNA, 24 nt, Zea mays
accgaugcaagucgcugcaccagg

SEQ ID NO: 5914 - RNA, 20 nt, Zea mays
ccgcguccuuccacgccguc

SEQ ID NO: 5915 - RNA, 24 nt, Zea mays
gauugagauugcacgcuauguggc

SEQ ID NO: 5916 - RNA, 24 nt, Zea mays
accggcacuuagcaccauccacaa

SEQ ID NO: 5917 - RNA, 24 nt, Zea mays
gccuuagcaaccgauacaccaccu

SEQ ID NO: 5918 - RNA, 24 nt, Zea mays
gucgucgucggaugcgguguccag

SEQ ID NO: 5919 - RNA, 22 nt, Zea mays
gcacguggaggacgucugcgag

SEQ ID NO: 5920 - RNA, 22 nt, Zea mays
cggcuagaugggccacaugggc

SEQ ID NO: 5921 - RNA, 24 nt, Zea mays
ugaggcgcuuggaggaugcugcga

SEQ ID NO: 5922 - RNA, 25 nt, Zea mays
ccuauacgguugcucgugcugguca

SEQ ID NO: 5923 - RNA, 21 nt, Zea mays
gaaguagcccacgccgaccgu

SEQ ID NO: 5924 - RNA, 24 nt, Zea mays
ucgccggaucugcgcagccccaac

SEQ ID NO: 5925 - RNA, 20 nt, Zea mays
cgaacaguguccggugcgcc

SEQ ID NO: 5926 - RNA, 20 nt, Zea mays
ccugggcgcuuugacagaca

SEQ ID NO: 5927 - RNA, 22 nt, Zea mays
uauagcgccuuggacaaccugu

SEQ ID NO: 5928 - RNA, 20 nt, Zea mays
uguuggaccaccugguguug

SEQ ID NO: 5929 - RNA, 21 nt, Zea mays
ccggacaguccgcgcgugcgc

SEQ ID NO: 5930 - RNA, 20 nt, Zea mays
auccacuaagugcugauuug

SEQ ID NO: 5931 - RNA, 21 nt, Zea mays
acccggagagccugcggugga

SEQ ID NO: 5932 - RNA, 21 nt, Zea mays
gcgccaccaggcaggccgccg

SEQ ID NO: 5933 - RNA, 21 nt, Zea mays
ggcguggcgucgaugggugug

SEQ ID NO: 5934 - RNA, 22 nt, Zea mays
gcgcaggcgcuccgcgcgaggc

SEQ ID NO: 5935 - RNA, 20 nt, Zea mays
caagggggagcucagugacg

SEQ ID NO: 5936 - RNA, 21 nt, Zea mays
uggagucagcaauggagucua

SEQ ID NO: 5937 - RNA, 22 nt, Zea mays
acacaugcauaccgaccugucu

SEQ ID NO: 5938 - RNA, 20 nt, Zea mays
ugacaucauuagcugcagca

SEQ ID NO: 5939 - RNA, 22 nt, Zea mays
gcuccaggacuucuucaacggc

SEQ ID NO: 5940 - RNA, 24 nt, Zea mays
cggguccggcggaucaggcacggu

SEQ ID NO: 5941 - RNA, 22 nt, Zea mays
ccggacaguccggugugccaga

SEQ ID NO: 5942 - RNA, 20 nt, Zea mays
cauccucauguguuucagua

SEQ ID NO: 5943 - RNA, 20 nt, Zea mays
gaaggcggccggggagcgcg

SEQ ID NO: 5944 - RNA, 21 nt, Zea mays
gcacuggggcuaucauggcag

SEQ ID NO: 5945 - RNA, 23 nt, Zea mays
caagucggacuaccucccgccca

SEQ ID NO: 5946 - RNA, 21 nt, Zea mays
gggacuaugcuucgucgccga

SEQ ID NO: 5947 - RNA, 24 nt, Zea mays
cggugauggaaggcgucggccgca

SEQ ID NO: 5948 - RNA, 22 nt, Zea mays
gcauccaccgccgccuugcccu

SEQ ID NO: 5949 - RNA, 21 nt, Zea mays
uccugcgauacggucgguugg

SEQ ID NO: 5950 - RNA, 22 nt, Zea mays
gcgucggguggcgaggaguugg

SEQ ID NO: 5951 - RNA, 21 nt, Zea mays
ccccgcgguggcugcucugcu

SEQ ID NO: 5952 - RNA, 21 nt, Zea mays
gggagggcgcacggcuggaga

SEQ ID NO: 5953 - RNA, 22 nt, Zea mays
cuggcacuucagcuuuugugga

SEQ ID NO: 5954 - RNA, 23 nt, Zea mays
auguguuuauauucugcucgaca

SEQ ID NO: 5955 - RNA, 24 nt, Zea mays
gccacgcucuaccucgccgccacc

SEQ ID NO: 5956 - RNA, 23 nt, Zea mays
ccagcggggauuggauucuaccu

SEQ ID NO: 5957 - RNA, 21 nt, Zea mays
gcgcaccaggagcuucgcagc

SEQ ID NO: 5958 - RNA, 20 nt, Zea mays
ggggaggcgcgcggcgacga

SEQ ID NO: 5959 - RNA, 21 nt, Zea mays
ggcuucgugcucccgcugcgc

SEQ ID NO: 5960 - RNA, 22 nt, Zea mays
gucgcgccgccgcgggagcaag

SEQ ID NO: 5961 - RNA, 21 nt, Zea mays
ucgaacgcgaggucgacgccc

SEQ ID NO: 5962 - RNA, 24 nt, Zea mays
ccgcgacguccaccgcuccgaccc

SEQ ID NO: 5963 - RNA, 24 nt, Zea mays
gacgucgucgccgccggcgggguc

SEQ ID NO: 5964 - RNA, 24 nt, Zea mays
gcuacaaggaugacccuacagugc

SEQ ID NO: 5965 - RNA, 20 nt, Zea mays
gucgaugccgagggugcugc

SEQ ID NO: 5966 - RNA, 24 nt, Zea mays
ugcucccgcuaugaaacgagacga

SEQ ID NO: 5967 - RNA, 21 nt, Zea mays
ccagagaccagguucugacca

SEQ ID NO: 5968 - RNA, 25 nt, Zea mays
gggacgccgcccagggccgccgcca

SEQ ID NO: 5969 - RNA, 21 nt, Zea mays
gggcggcgcuggcggcaugga

SEQ ID NO: 5970 - RNA, 24 nt, Zea mays
acuacuagucauaggggccuuucc

SEQ ID NO: 5971 - RNA, 24 nt, Zea mays
gcgguucagauaaucaacaggcga

SEQ ID NO: 5972 - RNA, 25 nt, Zea mays
cagcggcgaccaugaccugcuggug

SEQ ID NO: 5973 - RNA, 24 nt, Zea mays
ggcagcacuagaaccggcauggac

SEQ ID NO: 5974 - RNA, 21 nt, Zea mays
uguuuggcgucagucuuugug

SEQ ID NO: 5975 - RNA, 22 nt, Zea mays
gauacgcgauuguuuuggauga

SEQ ID NO: 5976 - RNA, 21 nt, Zea mays
gcgguggcggauugcuagugc

SEQ ID NO: 5977 - RNA, 24 nt, Zea mays
cgcugcugaagcugucgaucccgc

SEQ ID NO: 5978 - RNA, 21 nt, Zea mays
ucgccugcaggccuuggguga

SEQ ID NO: 5979 - RNA, 20 nt, Zea mays
cccugcaucgaccgccuugc

SEQ ID NO: 5980 - RNA, 22 nt, Zea mays
ugccgaaugagcacucugaugg

SEQ ID NO: 5981 - RNA, 23 nt, Zea mays
cggacuguccggugugccaccag

SEQ ID NO: 5982 - RNA, 22 nt, Zea mays
gugggugugcuguggagaggag

SEQ ID NO: 5983 - RNA, 23 nt, Zea mays
gcugcaggaaauaccacggcugc

SEQ ID NO: 5984 - RNA, 22 nt, Zea mays
ugcgcgacgacgacgcccgccc

SEQ ID NO: 5985 - RNA, 20 nt, Zea mays
gcgcccccgugugccgaggu

SEQ ID NO: 5986 - RNA, 20 nt, Zea mays
ugccagucgggcccgugccg

SEQ ID NO: 5987 - RNA, 21 nt, Zea mays
ucgagggcuaacaaggaguuc

SEQ ID NO: 5988 - RNA, 22 nt, Zea mays
uggccgugcaguuccuggggau

SEQ ID NO: 5989 - RNA, 24 nt, Zea mays
cagagaguaugcaugcuuccgucc

SEQ ID NO: 5990 - RNA, 24 nt, Zea mays
ccacaccauauucaauaucagcga

SEQ ID NO: 5991 - RNA, 20 nt, Zea mays
ggcaaucaucucaagcuagg

SEQ ID NO: 5992 - RNA, 22 nt, Zea mays
guagguguuugcgaggaauuca

SEQ ID NO: 5993 - RNA, 20 nt, Zea mays
gaggagcugauccaccgccg

SEQ ID NO: 5994 - RNA, 21 nt, Zea mays
aguagucaagaagcacgagag

SEQ ID NO: 5995 - RNA, 21 nt, Zea mays
uccuacuaccgcgacaugacc

SEQ ID NO: 5996 - RNA, 24 nt, Zea mays
cagcagccauggucccaggacgga

SEQ ID NO: 5997 - RNA, 22 nt, Zea mays
gcagcucagcgaccucugcagc

SEQ ID NO: 5998 - RNA, 21 nt, Zea mays
gcuggcugucggcggcgucca

SEQ ID NO: 5999 - RNA, 24 nt, Zea mays
ucuggagcaagcgcuucgacccga

SEQ ID NO: 6000 - RNA, 21 nt, Zea mays
ggccgcaggcgcccgccgugg

SEQ ID NO: 6001 - RNA, 21 nt, Zea mays
ugcaucaagcaggccaucaag

SEQ ID NO: 6002 - RNA, 24 nt, Zea mays
ugggauugaaguguuuucaaggga

SEQ ID NO: 6003 - RNA, 20 nt, Zea mays
aggagauccgcggcgccgcc

SEQ ID NO: 6004 - RNA, 24 nt, Zea mays
aggaguauucagcugugcugugcg

SEQ ID NO: 6005 - RNA, 23 nt, Zea mays
cguggccgcgcgccgccugccca

SEQ ID NO: 6006 - RNA, 22 nt, Zea mays
gcggagaagcugcgucguggcc

SEQ ID NO: 6007 - RNA, 20 nt, Zea mays
gcacgccagucgaucgccgc

SEQ ID NO: 6008 - RNA, 22 nt, Zea mays
ccgccgcagacccaccucgcca

SEQ ID NO: 6009 - RNA, 20 nt, Zea mays
cacucgugcgacucuuugcc

SEQ ID NO: 6010 - RNA, 21 nt, Zea mays
ccgguuucugugaucacauuc

SEQ ID NO: 6011 - RNA, 24 nt, Zea mays
cgcaaacgcaaccaccgaaccgag

SEQ ID NO: 6012 - RNA, 21 nt, Zea mays
caacaaugauucccuuagugc

SEQ ID NO: 6013 - RNA, 22 nt, Zea mays
aaacgagagguaacuggcuaug

SEQ ID NO: 6014 - RNA, 25 nt, Zea mays
ugcgccgcuacuccgcgcugcccaa

SEQ ID NO: 6015 - RNA, 21 nt, Zea mays
gcacugccguucucuuuauuu

SEQ ID NO: 6016 - RNA, 24 nt, Zea mays
ccuugcccaagauaguucucugau

SEQ ID NO: 6017 - RNA, 25 nt, Zea mays
ggccgcucuuccuuggagcaccgga

SEQ ID NO: 6018 - RNA, 25 nt, Zea mays
gcagcagcuugacuauggucugguu

SEQ ID NO: 6019 - RNA, 22 nt, Zea mays
caccgaacaguccggugcaccc

SEQ ID NO: 6020 - RNA, 25 nt, Zea mays
cagacgcaagcccgcccgccgcagc

SEQ ID NO: 6021 - RNA, 22 nt, Zea mays
caccagacuguccggugcgcca

SEQ ID NO: 6022 - RNA, 20 nt, Zea mays
cugcacugcacgccuccgcc

SEQ ID NO: 6023 - RNA, 21 nt, Zea mays
ggucgucaggcgaaggcgcgg

SEQ ID NO: 6024 - RNA, 22 nt, Zea mays
gcucaucuugcccaucgagcua

SEQ ID NO: 6025 - RNA, 22 nt, Zea mays
gacaucuuggaugcccugucug

SEQ ID NO: 6026 - RNA, 21 nt, Zea mays
ccccgacgauggcgagugguc

SEQ ID NO: 6027 - RNA, 25 nt, Zea mays
cgcgacccgggccgcgugccagcgu

SEQ ID NO: 6028 - RNA, 23 nt, Zea mays
gcgucgggaggucugcucgguaa

SEQ ID NO: 6029 - RNA, 21 nt, Zea mays
aggacgccgaccgggaccauc

SEQ ID NO: 6030 - RNA, 21 nt, Zea mays
ucguggggagcucggcgcugg

SEQ ID NO: 6031 - RNA, 20 nt, Zea mays
cucgcgccgccgcacccugc

SEQ ID NO: 6032 - RNA, 23 nt, Zea mays
ggcggcaagguguaugaugugac

SEQ ID NO: 6033 - RNA, 20 nt, Zea mays
cccagucccagccacguccu

SEQ ID NO: 6034 - RNA, 22 nt, Zea mays
uccuccuccgagaccuucagcc

SEQ ID NO: 6035 - RNA, 22 nt, Zea mays
ugcgagugcgccuguggacugu

SEQ ID NO: 6036 - RNA, 24 nt, Zea mays
cgcgucagccacaggggcaucggc

SEQ ID NO: 6037 - RNA, 21 nt, Zea mays
cgcacgcccgacuugcccgcc

SEQ ID NO: 6038 - RNA, 23 nt, Zea mays
ccgccggccgagccugccuccuc

SEQ ID NO: 6039 - RNA, 21 nt, Zea mays
caaccgccgcuccugccgcuc

SEQ ID NO: 6040 - RNA, 24 nt, Zea mays
gcacuuggcaaagguugucucugc

SEQ ID NO: 6041 - RNA, 24 nt, Zea mays
uucucagagccuuagcaccugcca

SEQ ID NO: 6042 - RNA, 25 nt, Zea mays
aacauagggcuauccgagcuaucaa

SEQ ID NO: 6043 - RNA, 21 nt, Zea mays
acauccgggccgucgagcgcu

SEQ ID NO: 6044 - RNA, 24 nt, Zea mays
cacgguguacgcgacggcggugga

SEQ ID NO: 6045 - RNA, 22 nt, Zea mays
ggcagaugaggagcaggcccca

SEQ ID NO: 6046 - RNA, 23 nt, Zea mays
cagcagcaauagacguggggugg

SEQ ID NO: 6047 - RNA, 21 nt, Zea mays
gaccgcgauccuggcagccca

SEQ ID NO: 6048 - RNA, 20 nt, Zea mays
ggucgacgucagcagcccgg

SEQ ID NO: 6049 - RNA, 20 nt, Zea mays
gcagcucgagguugugcgcc

SEQ ID NO: 6050 - RNA, 23 nt, Zea mays
caguguagggagguccuuggguu

SEQ ID NO: 6051 - RNA, 23 nt, Zea mays
guccacggucgccggacuucgcc

SEQ ID NO: 6052 - RNA, 21 nt, Zea mays
cagguccagcucgucguccgc

SEQ ID NO: 6053 - RNA, 22 nt, Zea mays
ugguggacucccccugcugccu

SEQ ID NO: 6054 - RNA, 24 nt, Zea mays
gcuguugggcagggaaggccugga

SEQ ID NO: 6055 - RNA, 20 nt, Zea mays
gacgucggcagcugcguguc

SEQ ID NO: 6056 - RNA, 20 nt, Zea mays
cgacacugcucuucggaugg

SEQ ID NO: 6057 - RNA, 23 nt, Zea mays
ucgaggaugucuugcaacugcgg

SEQ ID NO: 6058 - RNA, 20 nt, Zea mays
ggauaccuagggcaagcugc

SEQ ID NO: 6059 - RNA, 24 nt, Zea mays
cggcuugccacgccauaaaccggg

SEQ ID NO: 6060 - RNA, 22 nt, Zea mays
ggucccgcucggccucggcgcc

SEQ ID NO: 6061 - RNA, 22 nt, Zea mays
cggaagcagccuggcaucgcga

SEQ ID NO: 6062 - RNA, 20 nt, Zea mays
uaccacuauuggcauugacu

SEQ ID NO: 6063 - RNA, 21 nt, Zea mays
ccagcgacuggugcuugugua

SEQ ID NO: 6064 - RNA, 24 nt, Zea mays
gcggcugcaagugcgaccccugca

SEQ ID NO: 6065 - RNA, 23 nt, Zea mays
uuaagcuaacgagccagcucggc

SEQ ID NO: 6066 - RNA, 24 nt, Zea mays
cgucgacgacugggcuaccggcgc

SEQ ID NO: 6067 - RNA, 20 nt, Zea mays
gcuacagucaugugguguaa

SEQ ID NO: 6068 - RNA, 22 nt, Zea mays
ggaccagaucgauucagcaucc

SEQ ID NO: 6069 - RNA, 23 nt, Zea mays
ccugcagauggaguacguggacc

SEQ ID NO: 6070 - RNA, 22 nt, Zea mays
uccuccugcggaugacaguagu

SEQ ID NO: 6071 - RNA, 20 nt, Zea mays
cugcggcucgacgguguggc

SEQ ID NO: 6072 - RNA, 20 nt, Zea mays
ggccgacaucuuugguauca

SEQ ID NO: 6073 - RNA, 20 nt, Zea mays
gucuuggaugcuugguuugc

SEQ ID NO: 6074 - RNA, 20 nt, Zea mays
uagcggguuuucggaagcua

SEQ ID NO: 6075 - RNA, 22 nt, Zea mays
ggacuggcaaaggggcccacug

SEQ ID NO: 6076 - RNA, 21 nt, Zea mays
caccugcaggcacucguucgu

SEQ ID NO: 6077 - RNA, 21 nt, Zea mays
gugugggugcagcacgguagc

SEQ ID NO: 6078 - RNA, 20 nt, Zea mays
ggaugggugauacauuagcu

SEQ ID NO: 6079 - RNA, 20 nt, Zea mays
ggagcacaagaccggcggca

SEQ ID NO: 6080 - RNA, 23 nt, Zea mays
gcgccgcgcaccucgcccgcacc

SEQ ID NO: 6081 - RNA, 22 nt, Zea mays
ggaaagaagcuauccacgugcc

SEQ ID NO: 6082 - RNA, 20 nt, Zea mays
gcccuuuaugugaucaagag

SEQ ID NO: 6083 - RNA, 24 nt, Zea mays
agaacaucacgugugggugacaua

SEQ ID NO: 6084 - RNA, 24 nt, Zea mays
gagcgagccgcauacaccgagccc

SEQ ID NO: 6085 - RNA, 21 nt, Zea mays
ccugagauaacggugcagucc

SEQ ID NO: 6086 - RNA, 21 nt, Zea mays
accaaucccacagcccgaggc

SEQ ID NO: 6087 - RNA, 24 nt, Zea mays
ccgacgcgcagucucagugaugaa

SEQ ID NO: 6088 - RNA, 22 nt, Zea mays
ucguuuagggguagcuuuggaa

SEQ ID NO: 6089 - RNA, 24 nt, Zea mays
cggcggaggccguaggaugacccc

SEQ ID NO: 6090 - RNA, 21 nt, Zea mays
cgagaaacauucuugugugua

SEQ ID NO: 6091 - RNA, 20 nt, Zea mays
ccauggcaacuacaaaggcc

SEQ ID NO: 6092 - RNA, 23 nt, Zea mays
ccagacggcgaccuggcgcggcu

SEQ ID NO: 6093 - RNA, 23 nt, Zea mays
cccagcuugucgagucccaggaa

SEQ ID NO: 6094 - RNA, 22 nt, Zea mays
ugacaccaaaugggaugcaaga

SEQ ID NO: 6095 - RNA, 21 nt, Zea mays
gcguaucguauccgguguaca

SEQ ID NO: 6096 - RNA, 24 nt, Zea mays
aagaccugucagaaugcggccuua

SEQ ID NO: 6097 - RNA, 20 nt, Zea mays
uccauuagagggcagccuca

SEQ ID NO: 6098 - RNA, 21 nt, Zea mays
gcacuggguuccuccaagccc

SEQ ID NO: 6099 - RNA, 21 nt, Zea mays
cgggcgcgcgauggauuggga

SEQ ID NO: 6100 - RNA, 24 nt, Zea mays
gcaacauucaagcagugugcacgg

SEQ ID NO: 6101 - RNA, 22 nt, Zea mays
gggaacugcuacgcugugcgcc

SEQ ID NO: 6102 - RNA, 25 nt, Zea mays
cacgaccacgaccaccacggcagca

SEQ ID NO: 6103 - RNA, 22 nt, Zea mays
cgccgucgucguccacgccgcc

SEQ ID NO: 6104 - RNA, 20 nt, Zea mays
guccucgaucgucguccauc

SEQ ID NO: 6105 - RNA, 24 nt, Zea mays
gagcgagauccaggcgccgucggc

SEQ ID NO: 6106 - RNA, 24 nt, Zea mays
gcugcugcgguugucuuuguuguu

SEQ ID NO: 6107 - RNA, 21 nt, Zea mays
cgagccauaacgagccgagcu

SEQ ID NO: 6108 - RNA, 20 nt, Zea mays
ucaaggaggcgcuccccgcu

SEQ ID NO: 6109 - RNA, 21 nt, Zea mays
cccgcgcgacgagcaccagca

SEQ ID NO: 6110 - RNA, 23 nt, Zea mays
uggcggcggcgacuuccucuucc

SEQ ID NO: 6111 - RNA, 20 nt, Zea mays
caaggcugagcgugagagag

SEQ ID NO: 6112 - RNA, 20 nt, Zea mays
ccugcuguguugugucacca

SEQ ID NO: 6113 - RNA, 25 nt, Zea mays
gaccgggcgggugacuugcacgaga

SEQ ID NO: 6114 - RNA, 20 nt, Zea mays
gggcaugcggggcgccauca

SEQ ID NO: 6115 - RNA, 21 nt, Zea mays
gaacaccagcugagacuacuc

SEQ ID NO: 6116 - RNA, 21 nt, Zea mays
caccgccauggcccugccgcc

SEQ ID NO: 6117 - RNA, 23 nt, Zea mays
ggucggcgccggguccgucgugc

SEQ ID NO: 6118 - RNA, 23 nt, Zea mays
uguccacgugcuacccgcgcccg

SEQ ID NO: 6119 - RNA, 24 nt, Zea mays
ugcgaagccugcccgagcugggcc

SEQ ID NO: 6120 - RNA, 20 nt, Zea mays
ccucgagcugagggcggcga

SEQ ID NO: 6121 - RNA, 20 nt, Zea mays
uggggaagacgccggugcgg

SEQ ID NO: 6122 - RNA, 24 nt, Zea mays
cgcggcgccgccgauccaagaugc

SEQ ID NO: 6123 - RNA, 21 nt, Zea mays
ugucgggagaugagcaagagc

SEQ ID NO: 6124 - RNA, 24 nt, Zea mays
auagcuagucgcgucgcagucggc

SEQ ID NO: 6125 - RNA, 23 nt, Zea mays
uugccggcaggaaguaugcagcu

SEQ ID NO: 6126 - RNA, 21 nt, Zea mays
cgcgggccggauccgucgcca

SEQ ID NO: 6127 - RNA, 20 nt, Zea mays
gcggucgaccgucggccaug

SEQ ID NO: 6128 - RNA, 24 nt, Zea mays
uccgcuaucguuuugucucuccua

SEQ ID NO: 6129 - RNA, 23 nt, Zea mays
ggccggcaacgacgccuaccgca

SEQ ID NO: 6130 - RNA, 21 nt, Zea mays
caccagacuguccggugagcc

SEQ ID NO: 6131 - RNA, 24 nt, Zea mays
ggccgaggccuaaggucgggcgag

SEQ ID NO: 6132 - RNA, 20 nt, Zea mays
cugcgaggacauguugcguc

SEQ ID NO: 6133 - RNA, 22 nt, Zea mays
gagcggcaaguacacccugggc

SEQ ID NO: 6134 - RNA, 22 nt, Zea mays
uuguauguggcagcuucgcacu

SEQ ID NO: 6135 - RNA, 24 nt, Zea mays
uccucccaacucaacuggccugca

SEQ ID NO: 6136 - RNA, 24 nt, Zea mays
gaagacuuguucgguccacggagu

SEQ ID NO: 6137 - RNA, 20 nt, Zea mays
gcuccgaucgcugccguugc

SEQ ID NO: 6138 - RNA, 20 nt, Zea mays
cagcucuccugcguguucga

SEQ ID NO: 6139 - RNA, 20 nt, Zea mays
gagccaggaguuuucguugc

SEQ ID NO: 6140 - RNA, 20 nt, Zea mays
ggccauggauugccagcguc

SEQ ID NO: 6141 - RNA, 23 nt, Zea mays
ccaggagcaaccaccgcuagauc

SEQ ID NO: 6142 - RNA, 20 nt, Zea mays
ccgacggcgaugggcgagga

SEQ ID NO: 6143 - RNA, 20 nt, Zea mays
ugcggagaggcugcuucgaa

SEQ ID NO: 6144 - RNA, 23 nt, Zea mays
ucccugccgacgccguuccugac

SEQ ID NO: 6145 - RNA, 21 nt, Zea mays
ggcuccaggagcucgccgacg

SEQ ID NO: 6146 - RNA, 21 nt, Zea mays
caucugccauaccgcucucga

SEQ ID NO: 6147 - RNA, 22 nt, Zea mays
ccgccgcgcggcucggguucgg

SEQ ID NO: 6148 - RNA, 22 nt, Zea mays
aaaacaaauccgcgugucacac

SEQ ID NO: 6149 - RNA, 24 nt, Zea mays
cagaucuccuucuggguccagguc

SEQ ID NO: 6150 - RNA, 25 nt, Zea mays
gcauuaggugauaggaguuguguga

SEQ ID NO: 6151 - RNA, 25 nt, Zea mays
uccgccucacccgaccccagggcuc

SEQ ID NO: 6152 - RNA, 24 nt, Zea mays
gggcggcgcuggcggcauggacga

SEQ ID NO: 6153 - RNA, 21 nt, Zea mays
ugccauguaggugacgagcuc

SEQ ID NO: 6154 - RNA, 22 nt, Zea mays
gaggaggaggaggggcucaacg

SEQ ID NO: 6155 - RNA, 21 nt, Zea mays
ggguguucgcggcagcuacuc

SEQ ID NO: 6156 - RNA, 25 nt, Zea mays
gcucggcgccggccaccccaagucc

SEQ ID NO: 6157 - RNA, 22 nt, Zea mays
gcagcgaugcgccgugcguucu

SEQ ID NO: 6158 - RNA, 24 nt, Zea mays
ugcggcgcaucaugaccguccccu

SEQ ID NO: 6159 - RNA, 20 nt, Zea mays
cgucgguggcgcugccucgg

SEQ ID NO: 6160 - RNA, 21 nt, Zea mays
gcagccggagaucgguggaga

SEQ ID NO: 6161 - RNA, 23 nt, Zea mays
gcggugcgggagacggcugccga

SEQ ID NO: 6162 - RNA, 25 nt, Zea mays
ccgcggcggccgggacggacaggcg

SEQ ID NO: 6163 - RNA, 24 nt, Zea mays
cgguuacggucgugcuccucacca

SEQ ID NO: 6164 - RNA, 23 nt, Zea mays
gcugggccgccuccccgucgugc

SEQ ID NO: 6165 - RNA, 21 nt, Zea mays
ugacacaucauggugcuugug

SEQ ID NO: 6166 - RNA, 24 nt, Zea mays
cgagaagcagacgcgcgaugccca

SEQ ID NO: 6167 - RNA, 21 nt, Zea mays
ucccgcugcugcugccgcugc

SEQ ID NO: 6168 - RNA, 20 nt, Zea mays
gggcccaguacgaggugcag

SEQ ID NO: 6169 - RNA, 20 nt, Zea mays
ccaccaggacagacaccgcc

SEQ ID NO: 6170 - RNA, 22 nt, Zea mays
ccuggacggggucgacgagccg

SEQ ID NO: 6171 - RNA, 21 nt, Zea mays
ccagaaauccuuugaugacac

SEQ ID NO: 6172 - RNA, 24 nt, Zea mays
ggacaguguccggugcaccaggac

SEQ ID NO: 6173 - RNA, 24 nt, Zea mays
auggauugagagcaaaacgaacaa

SEQ ID NO: 6174 - RNA, 24 nt, Zea mays
cgcaggaaacaagaccggcguccc

SEQ ID NO: 6175 - RNA, 25 nt, Zea mays
ccgacgacgacagccuguucgaccu

SEQ ID NO: 6176 - RNA, 22 nt, Zea mays
ugcuuuccgaguagauggagcu

SEQ ID NO: 6177 - RNA, 22 nt, Zea mays
cgugaugagcggggcuuggcug

SEQ ID NO: 6178 - RNA, 22 nt, Zea mays
gcacugccgcuccacgugcgcc

SEQ ID NO: 6179 - RNA, 24 nt, Zea mays
ggucagugcugccgcuguucggcc

SEQ ID NO: 6180 - RNA, 22 nt, Zea mays
cacgcggggugccaucauuacu

SEQ ID NO: 6181 - RNA, 20 nt, Zea mays
gagagcgaguccuaccagag

SEQ ID NO: 6182 - RNA, 20 nt, Zea mays
cggagagcggcgacgugggc

SEQ ID NO: 6183 - RNA, 21 nt, Zea mays
ugccauguucucagccucagu

SEQ ID NO: 6184 - RNA, 23 nt, Zea mays
cgucggcggccucgccugggcca

SEQ ID NO: 6185 - RNA, 21 nt, Zea mays
ggcagcucagcgugacgcacc

SEQ ID NO: 6186 - RNA, 20 nt, Zea mays
gcaacaccugcaacugcggc

SEQ ID NO: 6187 - RNA, 23 nt, Zea mays
agcgaccccaacgcgagugccuc

SEQ ID NO: 6188 - RNA, 24 nt, Zea mays
cggcgcugcgcucccugggccaga

SEQ ID NO: 6189 - RNA, 24 nt, Zea mays
acguccagcgcuuuacccuucagc

SEQ ID NO: 6190 - RNA, 24 nt, Zea mays
ucgggcacggccucgaggcgacca

SEQ ID NO: 6191 - RNA, 24 nt, Zea mays
ucgugcuggugcaggcgcuggugu

SEQ ID NO: 6192 - RNA, 24 nt, Zea mays
ccucuugaucuacgucgccgcgac

SEQ ID NO: 6193 - RNA, 21 nt, Zea mays
gucacggaggcggcggcgaca

SEQ ID NO: 6194 - RNA, 24 nt, Zea mays
cucgucggcggugauguagagguc

SEQ ID NO: 6195 - RNA, 23 nt, Zea mays
gugcucauguucuugguguuggu

SEQ ID NO: 6196 - RNA, 22 nt, Zea mays
ccgguggguauggcuaugggac

SEQ ID NO: 6197 - RNA, 20 nt, Zea mays
gagcucggaacugucaugcg

SEQ ID NO: 6198 - RNA, 22 nt, Zea mays
cgccaccuacgagaggcugccg

SEQ ID NO: 6199 - RNA, 22 nt, Zea mays
uggagccaaaaucagaaauggg

SEQ ID NO: 6200 - RNA, 21 nt, Zea mays
uuggcagagguucgcgaugaa

SEQ ID NO: 6201 - RNA, 24 nt, Zea mays
auguucgcgcccgggucuuagugc

SEQ ID NO: 6202 - RNA, 25 nt, Zea mays
cggagggagagggggaggaggaguc

SEQ ID NO: 6203 - RNA, 24 nt, Zea mays
cucggagcuccggcucacugcgca

SEQ ID NO: 6204 - RNA, 21 nt, Zea mays
acgcaggcaagggcggcggcc

SEQ ID NO: 6205 - RNA, 20 nt, Zea mays
cuaucuccagcagcuuaccc

SEQ ID NO: 6206 - RNA, 22 nt, Zea mays
ucugcaguggaaagugcaacac

SEQ ID NO: 6207 - RNA, 20 nt, Zea mays
ugggccaucugaugugcaug

SEQ ID NO: 6208 - RNA, 23 nt, Zea mays
acaaguauccuuugccucguauu

SEQ ID NO: 6209 - RNA, 20 nt, Zea mays
gacccgcgauguugccuucg

SEQ ID NO: 6210 - RNA, 24 nt, Zea mays
cauggugcagcagacggugggcuu

SEQ ID NO: 6211 - RNA, 21 nt, Zea mays
ggcuuugguggaugggauggc

SEQ ID NO: 6212 - RNA, 20 nt, Zea mays
ccgccaggacgucguucgag

SEQ ID NO: 6213 - RNA, 24 nt, Zea mays
cgccagcagguucgcagcgugcac

SEQ ID NO: 6214 - RNA, 20 nt, Zea mays
cgucggggaguucaagugcg

SEQ ID NO: 6215 - RNA, 23 nt, Zea mays
cggcuggaucggagcuguuggga

SEQ ID NO: 6216 - RNA, 20 nt, Zea mays
gaaaggcggcaacgggcgcu

SEQ ID NO: 6217 - RNA, 20 nt, Zea mays
gccgucgcacgugcuggaga

SEQ ID NO: 6218 - RNA, 21 nt, Zea mays
agagcugaacucgacacaugc

SEQ ID NO: 6219 - RNA, 24 nt, Zea mays
uaccaucaagcacuguguccccga

SEQ ID NO: 6220 - RNA, 24 nt, Zea mays
auacaacuguaaggguacuaccca

SEQ ID NO: 6221 - RNA, 21 nt, Zea mays
aggugcaaggguuaaagagcg

SEQ ID NO: 6222 - RNA, 22 nt, Zea mays
uugucgauccgaucaaugcugg

SEQ ID NO: 6223 - RNA, 21 nt, Zea mays
ccaaggauguucugccgacca

SEQ ID NO: 6224 - RNA, 24 nt, Zea mays
ggguagugccgugccugggccgag

SEQ ID NO: 6225 - RNA, 24 nt, Zea mays
cgggcagcagcuggacaacgggca

SEQ ID NO: 6226 - RNA, 24 nt, Zea mays
gcuuuuugucgcgcacuuggugaa

SEQ ID NO: 6227 - RNA, 24 nt, Zea mays
accgauuucaggagcggaccggaa

SEQ ID NO: 6228 - RNA, 24 nt, Zea mays
aguagaaacgccauccuacaaagu

SEQ ID NO: 6229 - RNA, 24 nt, Zea mays
ggccgcgucccagugcgaagagac

SEQ ID NO: 6230 - RNA, 24 nt, Zea mays
cugaagcgucuucaucguccaauc

SEQ ID NO: 6231 - RNA, 24 nt, Zea mays
guggugacaaggaacaaagcccga

SEQ ID NO: 6232 - RNA, 20 nt, Zea mays
gcgcacgcguuccacguccc

SEQ ID NO: 6233 - RNA, 20 nt, Zea mays
cccauccaauuccagcugcu

SEQ ID NO: 6234 - RNA, 24 nt, Zea mays
agucuucuuaugagucauuuagua

SEQ ID NO: 6235 - RNA, 20 nt, Zea mays
cuggucggcgacgucccgug

SEQ ID NO: 6236 - RNA, 24 nt, Zea mays
ggugaucagaguugaugaggauac

SEQ ID NO: 6237 - RNA, 24 nt, Zea mays
cacguccagcagcguucugaucgc

SEQ ID NO: 6238 - RNA, 22 nt, Zea mays
gccaggcccugguccuugcucc

SEQ ID NO: 6239 - RNA, 20 nt, Zea mays
uggcauuugguuccacgucc

SEQ ID NO: 6240 - RNA, 24 nt, Zea mays
cugcccaaucucagaaucugccca

SEQ ID NO: 6241 - RNA, 24 nt, Zea mays
ggccucggauaauucuugcccgac

SEQ ID NO: 6242 - RNA, 20 nt, Zea mays
ggccaccgucguccucggcg

SEQ ID NO: 6243 - RNA, 21 nt, Zea mays
accccagcacgugccggccgu

SEQ ID NO: 6244 - RNA, 24 nt, Zea mays
gccugaagaaguugaucgccgaga

SEQ ID NO: 6245 - RNA, 20 nt, Zea mays
gcggcggcagcugcgacgga

SEQ ID NO: 6246 - RNA, 23 nt, Zea mays
ugguugggucuauauuucauacu

SEQ ID NO: 6247 - RNA, 24 nt, Zea mays
gcaccacaucaguugcucgaucau

SEQ ID NO: 6248 - RNA, 22 nt, Zea mays
cgccacuccgacugcagugcca

SEQ ID NO: 6249 - RNA, 21 nt, Zea mays
gugcugugaugaagaugcuca

SEQ ID NO: 6250 - RNA, 20 nt, Zea mays
ugcugauggucgguggucga

SEQ ID NO: 6251 - RNA, 21 nt, Zea mays
gggacgagauucuuuuaaggg

SEQ ID NO: 6252 - RNA, 24 nt, Zea mays
gaaugaaaugguggggcugcuagu

SEQ ID NO: 6253 - RNA, 24 nt, Zea mays
cauguguauuggaguguauugagu

SEQ ID NO: 6254 - RNA, 22 nt, Zea mays
ucgugcucaccaucauccgcga

SEQ ID NO: 6255 - RNA, 21 nt, Zea mays
gaugacggcguucgaguacca

SEQ ID NO: 6256 - RNA, 24 nt, Zea mays
gaacgaucgccuuucccagcugca

SEQ ID NO: 6257 - RNA, 21 nt, Zea mays
cugcacuacaacuacaccggc

SEQ ID NO: 6258 - RNA, 21 nt, Zea mays
ugaucgauagccggcagcaaa

SEQ ID NO: 6259 - RNA, 24 nt, Zea mays
ggagcacauuacccuaccauccag

SEQ ID NO: 6260 - RNA, 24 nt, Zea mays
gguugaagggauaaacuuggaugg

SEQ ID NO: 6261 - RNA, 22 nt, Zea mays
cgucgucgucaccucucucgcc

SEQ ID NO: 6262 - RNA, 21 nt, Zea mays
cgucgcagugccccgccgcgc

SEQ ID NO: 6263 - RNA, 23 nt, Zea mays
ucgccggcgacgagcacccagca

SEQ ID NO: 6264 - RNA, 24 nt, Zea mays
aggaacuaccuuauugugugcauu

SEQ ID NO: 6265 - RNA, 24 nt, Zea mays
cccuccgagggaccaguuugacua

SEQ ID NO: 6266 - RNA, 20 nt, Zea mays
ccuuuggugcaaucuaugcu

SEQ ID NO: 6267 - RNA, 25 nt, Zea mays
cggccgccgaggaggacugccgcag

SEQ ID NO: 6268 - RNA, 21 nt, Zea mays
ggcucgucggugcugugcaga

SEQ ID NO: 6269 - RNA, 21 nt, Zea mays
gaagccgggagcgccgccgga

SEQ ID NO: 6270 - RNA, 25 nt, Zea mays
ccugaagguaugccagggaugcugc

SEQ ID NO: 6271 - RNA, 21 nt, Zea mays
gagcauggggagccucgacgc

SEQ ID NO: 6272 - RNA, 24 nt, Zea mays
caucgcccccucgcaggugaccag

SEQ ID NO: 6273 - RNA, 23 nt, Zea mays
caacggucagaagggggcaccgg

SEQ ID NO: 6274 - RNA, 21 nt, Zea mays
gcgguagccugagcuuugcau

SEQ ID NO: 6275 - RNA, 22 nt, Zea mays
ugcggcagcuggccgucggcga

SEQ ID NO: 6276 - RNA, 22 nt, Zea mays
gcauccaguucaucggucguuu

SEQ ID NO: 6277 - RNA, 21 nt, Zea mays
ggaauucgaagagccuccaca

SEQ ID NO: 6278 - RNA, 24 nt, Zea mays
acgacgccuugaaugguccgauca

SEQ ID NO: 6279 - RNA, 24 nt, Zea mays
gacgguccacgauggcacagaggg

SEQ ID NO: 6280 - RNA, 24 nt, Zea mays
cagccucugaagccugcuccuggu

SEQ ID NO: 6281 - RNA, 24 nt, Zea mays
ugacaaugauuuguuuguaugcca

SEQ ID NO: 6282 - RNA, 22 nt, Zea mays
uggauuccucaguguguggcua

SEQ ID NO: 6283 - RNA, 20 nt, Zea mays
gacgagaccaggagcaacca

SEQ ID NO: 6284 - RNA, 21 nt, Zea mays
cgcugcugcuggugucguccc

SEQ ID NO: 6285 - RNA, 23 nt, Zea mays
ucgucgucgucguccguggugga

SEQ ID NO: 6286 - RNA, 24 nt, Zea mays
auguucaguacagauggguaugcu

SEQ ID NO: 6287 - RNA, 22 nt, Zea mays
uccgacucauccgagcccucga

SEQ ID NO: 6288 - RNA, 22 nt, Zea mays
uccccaucggguagcggguaug

SEQ ID NO: 6289 - RNA, 24 nt, Zea mays
gaggugugggaacaucauggugag

SEQ ID NO: 6290 - RNA, 24 nt, Zea mays
acaugcuaagauagaugaauuaaa

SEQ ID NO: 6291 - RNA, 20 nt, Zea mays
acggcgacggcgacggcgag

SEQ ID NO: 6292 - RNA, 22 nt, Zea mays
ucucccagcaggcugcuugaug

SEQ ID NO: 6293 - RNA, 20 nt, Zea mays
aggugcaaggauuaaagagc

SEQ ID NO: 6294 - RNA, 22 nt, Zea mays
caaacacaagggcguauagagu

SEQ ID NO: 6295 - RNA, 20 nt, Zea mays
cgccgucgccgaucggaggc

SEQ ID NO: 6296 - RNA, 20 nt, Zea mays
uacauggagaggcggcaaug

SEQ ID NO: 6297 - RNA, 21 nt, Zea mays
aggcagcuaggagccguugga

SEQ ID NO: 6298 - RNA, 21 nt, Zea mays
ccucguacucagcauaugcua

SEQ ID NO: 6299 - RNA, 20 nt, Zea mays
agggaaggcgaacuguugcu

SEQ ID NO: 6300 - RNA, 20 nt, Zea mays
cgacgaggacgggcccugcg

SEQ ID NO: 6301 - RNA, 23 nt, Zea mays
ggccgaacucgaguccugugcug

SEQ ID NO: 6302 - RNA, 22 nt, Zea mays
uguuccuucuguuccguuugcu

SEQ ID NO: 6303 - RNA, 24 nt, Zea mays
gguugugcuucggacguggaggga

SEQ ID NO: 6304 - RNA, 22 nt, Zea mays
ugcugcugcaacaagauggaug

SEQ ID NO: 6305 - RNA, 24 nt, Zea mays
gccgcgggucgucacgcugcaggu

SEQ ID NO: 6306 - RNA, 24 nt, Zea mays
cacagaaggugaugagugagguau

SEQ ID NO: 6307 - RNA, 21 nt, Zea mays
cuaaucaugccuuuaugccua

SEQ ID NO: 6308 - RNA, 25 nt, Zea mays
gagucugaugcuaaaucuuuguggu

SEQ ID NO: 6309 - RNA, 20 nt, Zea mays
uugguguuugaugauuaaca

SEQ ID NO: 6310 - RNA, 24 nt, Zea mays
ugcucugcagguagccguuggcgc

SEQ ID NO: 6311 - RNA, 24 nt, Zea mays
aggggagagagaggugaggcgcgg

SEQ ID NO: 6312 - RNA, 25 nt, Zea mays
gagucucauccggugacuguggugu

SEQ ID NO: 6313 - RNA, 21 nt, Zea mays
gagugcgaggaggcgauuggu

SEQ ID NO: 6314 - RNA, 22 nt, Zea mays
ugagucgacgguccaucagguc

SEQ ID NO: 6315 - RNA, 22 nt, Zea mays
ggccaugauuaagggucuucgg

SEQ ID NO: 6316 - RNA, 24 nt, Zea mays
ugccagagccaacccaaguuaguc

SEQ ID NO: 6317 - RNA, 20 nt, Zea mays
ggaauggaaagcaaaugugc

SEQ ID NO: 6318 - RNA, 20 nt, Zea mays
uggugacaaggggaucccgg

SEQ ID NO: 6319 - RNA, 21 nt, Zea mays
cgcgguggugauggacgggaa

SEQ ID NO: 6320 - RNA, 21 nt, Zea mays
ugaauugguguaaccgaacaa

SEQ ID NO: 6321 - RNA, 21 nt, Zea mays
gcagcuggaggauggucgcac

SEQ ID NO: 6322 - RNA, 24 nt, Zea mays
gcggagagguuguacgugauggcc

SEQ ID NO: 6323 - RNA, 21 nt, Zea mays
cgacaccgucaccgccgccgu

SEQ ID NO: 6324 - RNA, 21 nt, Zea mays
ccuugagucauuggugucuca

SEQ ID NO: 6325 - RNA, 24 nt, Zea mays
acugguagccgcugacgaagcugg

SEQ ID NO: 6326 - RNA, 20 nt, Zea mays
accccaagagcaugccccgg

SEQ ID NO: 6327 - RNA, 20 nt, Zea mays
cagggugagcucgccggcaa

SEQ ID NO: 6328 - RNA, 20 nt, Zea mays
uugggcaugaauugguuagc

SEQ ID NO: 6329 - RNA, 20 nt, Zea mays
ccuccaccuacugcuugcug

SEQ ID NO: 6330 - RNA, 21 nt, Zea mays
cgacgucgguggcguguuggg

SEQ ID NO: 6331 - RNA, 24 nt, Zea mays
uuauuccuugggaaccugcaacau

SEQ ID NO: 6332 - RNA, 24 nt, Zea mays
cggugcugcggcgccaugcagaug

SEQ ID NO: 6333 - RNA, 23 nt, Zea mays
aagggaacauaucugcugcaaaa

SEQ ID NO: 6334 - RNA, 24 nt, Zea mays
cucggagccuuggaucaucaacau

SEQ ID NO: 6335 - RNA, 22 nt, Zea mays
uccuuagcgcuaugcauggagc

SEQ ID NO: 6336 - RNA, 20 nt, Zea mays
cagccaccuucgucacguuc

SEQ ID NO: 6337 - RNA, 24 nt, Zea mays
caucugcacggggaggaagccgag

SEQ ID NO: 6338 - RNA, 23 nt, Zea mays
cgaccguggugcuuggcccucgc

SEQ ID NO: 6339 - RNA, 22 nt, Zea mays
cucccuggauacgccgccccuc

SEQ ID NO: 6340 - RNA, 22 nt, Zea mays
acugggcaagcgcugaugagga

SEQ ID NO: 6341 - RNA, 23 nt, Zea mays
ugacugggugcugugccggcugu

SEQ ID NO: 6342 - RNA, 21 nt, Zea mays
uaccuucgaugucucccuccu

SEQ ID NO: 6343 - RNA, 21 nt, Zea mays
caagucccugaugugcucuuu

SEQ ID NO: 6344 - RNA, 21 nt, Zea mays
cggcgaccaggugguggcgua

SEQ ID NO: 6345 - RNA, 21 nt, Zea mays
gcaggugaugaugauguuugg

SEQ ID NO: 6346 - RNA, 23 nt, Zea mays
cgcuugcggccgaccggucccgc

SEQ ID NO: 6347 - RNA, 23 nt, Zea mays
cgcgcacgucacgcacgagaccg

SEQ ID NO: 6348 - RNA, 20 nt, Zea mays
gcugcagcuauaccggccaa

SEQ ID NO: 6349 - RNA, 20 nt, Zea mays
ucugccggauugcugaggca

SEQ ID NO: 6350 - RNA, 20 nt, Zea mays
cuucggcagcagaagguguc

SEQ ID NO: 6351 - RNA, 24 nt, Zea mays
caagaacagguaccgcaagaugag

SEQ ID NO: 6352 - RNA, 21 nt, Zea mays
gaggcagaguacgagaucaga

SEQ ID NO: 6353 - RNA, 21 nt, Zea mays
caucguuggugaugcuggugu

SEQ ID NO: 6354 - RNA, 23 nt, Zea mays
caccggggacggcggagugugcg

SEQ ID NO: 6355 - RNA, 21 nt, Zea mays
cggcggggguggcgaggauga

SEQ ID NO: 6356 - RNA, 24 nt, Zea mays
uggcuuugguucuguagccaugau

SEQ ID NO: 6357 - RNA, 21 nt, Zea mays
guacaagaccgacagggccaa

SEQ ID NO: 6358 - RNA, 20 nt, Zea mays
gauuccguucuacuuggcuc

SEQ ID NO: 6359 - RNA, 21 nt, Zea mays
gccaggggagucacguccguu

SEQ ID NO: 6360 - RNA, 23 nt, Zea mays
cagcuugcuggagugguugcagu

SEQ ID NO: 6361 - RNA, 21 nt, Zea mays
cgccgcggccgccgucccucg

SEQ ID NO: 6362 - RNA, 22 nt, Zea mays
uggccaauacccaauccggauc

SEQ ID NO: 6363 - RNA, 25 nt, Zea mays
cguaccagauggugucacggcagag

SEQ ID NO: 6364 - RNA, 20 nt, Zea mays
ggagugcagguacacggugu

SEQ ID NO: 6365 - RNA, 22 nt, Zea mays
caccaccucgguauguugcgcc

SEQ ID NO: 6366 - RNA, 21 nt, Zea mays
accgauccucgccugcugcag

SEQ ID NO: 6367 - RNA, 20 nt, Zea mays
ugcguguacgcguccucgau

SEQ ID NO: 6368 - RNA, 23 nt, Zea mays
gagcggcgucacgagugaugggu

SEQ ID NO: 6369 - RNA, 22 nt, Zea mays
guggaccucaauuuguagccaa

SEQ ID NO: 6370 - RNA, 23 nt, Zea mays
ggaccuggcguccuguaguccug

SEQ ID NO: 6371 - RNA, 21 nt, Zea mays
ggcuuugccgagugccgcacu

SEQ ID NO: 6372 - RNA, 21 nt, Zea mays
gggaggggcggcgaugcgggg

SEQ ID NO: 6373 - RNA, 20 nt, Zea mays
cagcacaagaugaugaccgc

SEQ ID NO: 6374 - RNA, 20 nt, Zea mays
ccugaucuagcacacuugga

SEQ ID NO: 6375 - RNA, 21 nt, Zea mays
ggggaagaaauccucuugcua

SEQ ID NO: 6376 - RNA, 22 nt, Zea mays
gacaggugcaugugggcccaau

SEQ ID NO: 6377 - RNA, 23 nt, Zea mays
gugucuaagugcuggaaacagga

SEQ ID NO: 6378 - RNA, 24 nt, Zea mays
gcgagaagcagucgccaugucugg

SEQ ID NO: 6379 - RNA, 21 nt, Zea mays
gagggugaggugauugaugca

SEQ ID NO: 6380 - RNA, 20 nt, Zea mays
ggcgcugucgacucgcucga

SEQ ID NO: 6381 - RNA, 24 nt, Zea mays
gugucuucccagcccuggacccgc

SEQ ID NO: 6382 - RNA, 24 nt, Zea mays
gccaccugaucuacaagcuuggag

SEQ ID NO: 6383 - RNA, 23 nt, Zea mays
acacuauguguagaaaccuaaga

SEQ ID NO: 6384 - RNA, 21 nt, Zea mays
cagcgaagagauuccuggucc

SEQ ID NO: 6385 - RNA, 25 nt, Zea mays
uccucggcuccagcagacccaugca

SEQ ID NO: 6386 - RNA, 21 nt, Zea mays
acccugcuccgccucgucucg

SEQ ID NO: 6387 - RNA, 25 nt, Zea mays
gggauuccugcauuggagcuuccua

SEQ ID NO: 6388 - RNA, 24 nt, Zea mays
acuuugcggaauacgagaguaguc

SEQ ID NO: 6389 - RNA, 25 nt, Zea mays
cgcugggcaacagcugugccaccgu

SEQ ID NO: 6390 - RNA, 21 nt, Zea mays
agguauaccugcugcaaucau

SEQ ID NO: 6391 - RNA, 25 nt, Zea mays
gaccacacuaggaacaacaucauca

SEQ ID NO: 6392 - RNA, 20 nt, Zea mays
cuacuaggacggcaaucuca

SEQ ID NO: 6393 - RNA, 24 nt, Zea mays
cggcgaccucugcagcagcagcga

SEQ ID NO: 6394 - RNA, 23 nt, Zea mays
gaagcucguauaguaccugccaa

SEQ ID NO: 6395 - RNA, 24 nt, Zea mays
uauacuaaaauggaacaaaaugaa

SEQ ID NO: 6396 - RNA, 23 nt, Zea mays
gguguuugaggaguuucggucca

SEQ ID NO: 6397 - RNA, 22 nt, Zea mays
gcagcugaccaccgagaaccug

SEQ ID NO: 6398 - RNA, 23 nt, Zea mays
ccgcagauguagaugaauggccg

SEQ ID NO: 6399 - RNA, 24 nt, Zea mays
agguacuggucgcacguggugcag

SEQ ID NO: 6400 - RNA, 22 nt, Zea mays
gccauugccacguccgucgccc

SEQ ID NO: 6401 - RNA, 24 nt, Zea mays
agcgcgacaagaaggaggagccca

SEQ ID NO: 6402 - RNA, 22 nt, Zea mays
uuuaccaagguguugcucucuc

SEQ ID NO: 6403 - RNA, 20 nt, Zea mays
auccgggccgugcuggugga

SEQ ID NO: 6404 - RNA, 21 nt, Zea mays
gcgcgcgacguaguguucgac

SEQ ID NO: 6405 - RNA, 23 nt, Zea mays
agaagggggcuaagcaagguccg

SEQ ID NO: 6406 - RNA, 21 nt, Zea mays
agccaggucugcaaucuugcg

SEQ ID NO: 6407 - RNA, 24 nt, Zea mays
acaguccggugcacccagaccgag

SEQ ID NO: 6408 - RNA, 21 nt, Zea mays
aggccaaggagacuagcagug

SEQ ID NO: 6409 - RNA, 21 nt, Zea mays
ggagaggauggacgacuggaa

SEQ ID NO: 6410 - RNA, 21 nt, Zea mays
aggcgggcuccucguguacca

SEQ ID NO: 6411 - RNA, 22 nt, Zea mays
aacugcuucgacgucuucgaug

SEQ ID NO: 6412 - RNA, 20 nt, Zea mays
aagcauccuugccaacauug

SEQ ID NO: 6413 - RNA, 23 nt, Zea mays
cgacgccguguuccucagcccgc

SEQ ID NO: 6414 - RNA, 21 nt, Zea mays
cagagccgccgggaucccgca

SEQ ID NO: 6415 - RNA, 21 nt, Zea mays
accaaccagauucuugaggau

SEQ ID NO: 6416 - RNA, 20 nt, Zea mays
acgcucagggccgucuucga

SEQ ID NO: 6417 - RNA, 23 nt, Zea mays
ugggcgcgggacaaacacgaagg

SEQ ID NO: 6418 - RNA, 21 nt, Zea mays
ucgaagucagcgcaucgucga

SEQ ID NO: 6419 - RNA, 20 nt, Zea mays
ggcgcuggacgaggaggcca

SEQ ID NO: 6420 - RNA, 25 nt, Zea mays
ggcagcgagcgucucuccucuccca

SEQ ID NO: 6421 - RNA, 24 nt, Zea mays
ccgccguggcugcgccaccguuca

SEQ ID NO: 6422 - RNA, 24 nt, Zea mays
cgaggacgguuucagcuaugccag

SEQ ID NO: 6423 - RNA, 20 nt, Zea mays
uugucaagcaaaugugcugc

SEQ ID NO: 6424 - RNA, 20 nt, Zea mays
ugcucaaggagucuggcccu

SEQ ID NO: 6425 - RNA, 21 nt, Zea mays
ccaccaccaccguagccgccg

SEQ ID NO: 6426 - RNA, 24 nt, Zea mays
gggagaggaacggcggugggcugc

SEQ ID NO: 6427 - RNA, 25 nt, Zea mays
cuguccuuuugauccagaacucgaa

SEQ ID NO: 6428 - RNA, 20 nt, Zea mays
uggcuugcgugcgcccgcgc

SEQ ID NO: 6429 - RNA, 22 nt, Zea mays
cucgucggcgcugcaugggacg

SEQ ID NO: 6430 - RNA, 21 nt, Zea mays
uacggaugguaccugugcucc

SEQ ID NO: 6431 - RNA, 23 nt, Zea mays
cagugaccgcacuuguacccacc

SEQ ID NO: 6432 - RNA, 23 nt, Zea mays
cuucaaagaccgguacccugagc

SEQ ID NO: 6433 - RNA, 20 nt, Zea mays
uggcacugagccgcuucagg

SEQ ID NO: 6434 - RNA, 22 nt, Zea mays
ggccgucgagcuuccugaugcc

SEQ ID NO: 6435 - RNA, 24 nt, Zea mays
agguugcguagugagcuaaauguc

SEQ ID NO: 6436 - RNA, 21 nt, Zea mays
aacuggcaaacgcucacaagu

SEQ ID NO: 6437 - RNA, 21 nt, Zea mays
ugcagcugauccuggucugcc

SEQ ID NO: 6438 - RNA, 20 nt, Zea mays
acgaggcggccagugcucuc

SEQ ID NO: 6439 - RNA, 20 nt, Zea mays
gaagcuggagcacuuugacu

SEQ ID NO: 6440 - RNA, 24 nt, Zea mays
augugcauauauaaguuaucgaga

SEQ ID NO: 6441 - RNA, 24 nt, Zea mays
gcgcaggauaacacgagccgcggu

SEQ ID NO: 6442 - RNA, 24 nt, Zea mays
uggaaaauccuguugaguugcuca

SEQ ID NO: 6443 - RNA, 24 nt, Zea mays
gcagccuggcgcaccggacacugu

SEQ ID NO: 6444 - RNA, 24 nt, Zea mays
guuuuaguugucgcuggauagugc

SEQ ID NO: 6445 - RNA, 21 nt, Zea mays
aggugcaaggguuaaagagug

SEQ ID NO: 6446 - RNA, 20 nt, Zea mays
cacaauaccuggccacaccu

SEQ ID NO: 6447 - RNA, 21 nt, Zea mays
gcagaagaagcuuaaccuccc

SEQ ID NO: 6448 - RNA, 24 nt, Zea mays
caccggacuguccggugugccagu

SEQ ID NO: 6449 - RNA, 24 nt, Zea mays
ggagguguaccacccgggcgcccu

SEQ ID NO: 6450 - RNA, 24 nt, Zea mays
aagccaaaagucaaaccaaacaca

SEQ ID NO: 6451 - RNA, 24 nt, Zea mays
accggaccguccgcgaugcguagu

SEQ ID NO: 6452 - RNA, 22 nt, Zea mays
cgcgcacacgcacuuggccccg

SEQ ID NO: 6453 - RNA, 20 nt, Zea mays
cgcagccaagcuuccuuccc

SEQ ID NO: 6454 - RNA, 23 nt, Zea mays
agcucuagugcauucaaacaccc

SEQ ID NO: 6455 - RNA, 22 nt, Zea mays
cguuggauccgcguauauccca

SEQ ID NO: 6456 - RNA, 20 nt, Zea mays
agcgagguacgggcacccgg

SEQ ID NO: 6457 - RNA, 24 nt, Zea mays
caaagccaaagagccggaggcccg

SEQ ID NO: 6458 - RNA, 20 nt, Zea mays
ccgcuacagggacgcgccgu

SEQ ID NO: 6459 - RNA, 25 nt, Zea mays
cacuugcugaaccagauacccagca

SEQ ID NO: 6460 - RNA, 22 nt, Zea mays
uccccaaaugcuaagcaagcgc

SEQ ID NO: 6461 - RNA, 20 nt, Zea mays
guucagcgauugcauuggcg

SEQ ID NO: 6462 - RNA, 24 nt, Zea mays
gcggaugaucugcgucgugaccgc

SEQ ID NO: 6463 - RNA, 21 nt, Zea mays
cgcagaaaaaccauccauccu

SEQ ID NO: 6464 - RNA, 22 nt, Zea mays
ucuaagguugacgggccuucag

SEQ ID NO: 6465 - RNA, 20 nt, Zea mays
ggacaagaugaucugccgca

SEQ ID NO: 6466 - RNA, 21 nt, Zea mays
gucgucucagguacgagggcg

SEQ ID NO: 6467 - RNA, 24 nt, Zea mays
gaugaaugguucaaucacuugaug

SEQ ID NO: 6468 - RNA, 20 nt, Zea mays
gauuugcucagggaagcugc

SEQ ID NO: 6469 - RNA, 22 nt, Zea mays
aaguuggaucaucgauagcggg

SEQ ID NO: 6470 - RNA, 24 nt, Zea mays
cgacccagggcucggacucggccu

SEQ ID NO: 6471 - RNA, 22 nt, Zea mays
cagcuggaggauggccgcaccc

SEQ ID NO: 6472 - RNA, 22 nt, Zea mays
cgugcucgcgguuaugagcggc

SEQ ID NO: 6473 - RNA, 21 nt, Zea mays
gccguccucgaguaccuggcc

SEQ ID NO: 6474 - RNA, 24 nt, Zea mays
uacaaaugauuuguuuguaugcca

SEQ ID NO: 6475 - RNA, 20 nt, Zea mays
agggcucgugcugagaucgc

SEQ ID NO: 6476 - RNA, 23 nt, Zea mays
ggcaaggaggccaccgacguccg

SEQ ID NO: 6477 - RNA, 22 nt, Zea mays
cuugcggccuuccugcugcucc

SEQ ID NO: 6478 - RNA, 25 nt, Zea mays
uccgauaugugccucgcccuuggcc

SEQ ID NO: 6479 - RNA, 20 nt, Zea mays
gccucugcgaugccguugca

SEQ ID NO: 6480 - RNA, 25 nt, Zea mays
gucgggugaagacgaagcuagccga

SEQ ID NO: 6481 - RNA, 24 nt, Zea mays
cggcuggagcuuggccaggucguc

SEQ ID NO: 6482 - RNA, 22 nt, Zea mays
ugaucaggccgaucucgcauca

SEQ ID NO: 6483 - RNA, 22 nt, Zea mays
ucuuccuccgaagccccugguc

SEQ ID NO: 6484 - RNA, 22 nt, Zea mays
ggcucagagcuuuggugguggg

SEQ ID NO: 6485 - RNA, 24 nt, Zea mays
cacuccuccuuugcccuggugcga

SEQ ID NO: 6486 - RNA, 25 nt, Zea mays
ccugcgccacgcgggggucugcguc

SEQ ID NO: 6487 - RNA, 20 nt, Zea mays
agacgcugagcauggagccc

SEQ ID NO: 6488 - RNA, 24 nt, Zea mays
uggggcuuguucuucuguguugca

SEQ ID NO: 6489 - RNA, 23 nt, Zea mays
gcgcuccugcuucaagugcggua

SEQ ID NO: 6490 - RNA, 24 nt, Zea mays
guacgugucugugugugcaucugc

SEQ ID NO: 6491 - RNA, 22 nt, Zea mays
gugcacaccacugauaaggcuc

SEQ ID NO: 6492 - RNA, 20 nt, Zea mays
uuggugagccuggcguugcc

SEQ ID NO: 6493 - RNA, 22 nt, Zea mays
gccaucaguggccuucgggccg

SEQ ID NO: 6494 - RNA, 21 nt, Zea mays
agcggcagcacgagcucggcg

SEQ ID NO: 6495 - RNA, 24 nt, Zea mays
aagcacuccuccgacggccacgac

SEQ ID NO: 6496 - RNA, 24 nt, Zea mays
ccggaacagcuccucggagguagu

SEQ ID NO: 6497 - RNA, 23 nt, Zea mays
ggccaugaugugccugcaccagu

SEQ ID NO: 6498 - RNA, 24 nt, Zea mays
cagcuagcgcgcuccucgagccca

SEQ ID NO: 6499 - RNA, 21 nt, Zea mays
ucuucugcgucuaccgcgacc

SEQ ID NO: 6500 - RNA, 25 nt, Zea mays
gggcucgcuggcgggguggcugucc

SEQ ID NO: 6501 - RNA, 25 nt, Zea mays
cgcccgcgccgcccgugguggugga

SEQ ID NO: 6502 - RNA, 23 nt, Zea mays
cggcgacgaccggucggacgagg

SEQ ID NO: 6503 - RNA, 22 nt, Zea mays
aacaaaguggguguucagaaac

SEQ ID NO: 6504 - RNA, 20 nt, Zea mays
acguguggauacaguucuac

SEQ ID NO: 6505 - RNA, 20 nt, Zea mays
ugcguggcuugccuauggaa

SEQ ID NO: 6506 - RNA, 20 nt, Zea mays
ggcggcggucucuucuucga

SEQ ID NO: 6507 - RNA, 20 nt, Zea mays
acaccagcugaacuugccuc

SEQ ID NO: 6508 - RNA, 24 nt, Zea mays
gcgccauaggaagcucugccucgc

SEQ ID NO: 6509 - RNA, 24 nt, Zea mays
auugauagcgggugcacaaaccac

SEQ ID NO: 6510 - RNA, 24 nt, Zea mays
ucacgaacucaucgcagcauccuc

SEQ ID NO: 6511 - RNA, 24 nt, Zea mays
uacgucuaucugaaggugucgccu

SEQ ID NO: 6512 - RNA, 20 nt, Zea mays
gaggacgucgcggcggcuca

SEQ ID NO: 6513 - RNA, 23 nt, Zea mays
gcuucauuggaauggccggauau

SEQ ID NO: 6514 - RNA, 20 nt, Zea mays
ggugcaaucuaugcucaggu

SEQ ID NO: 6515 - RNA, 21 nt, Zea mays
cgccaggagaagguuccagag

SEQ ID NO: 6516 - RNA, 22 nt, Zea mays
ugacacaaacgagaaugccaaa

SEQ ID NO: 6517 - RNA, 23 nt, Zea mays
cgccagcggccaacggucgucca

SEQ ID NO: 6518 - RNA, 24 nt, Zea mays
auccauauggauugagggggauug

SEQ ID NO: 6519 - RNA, 20 nt, Zea mays
ucucuaugacgaccaaacac

SEQ ID NO: 6520 - RNA, 24 nt, Zea mays
cagauuaccaaacacagaacagag

SEQ ID NO: 6521 - RNA, 22 nt, Zea mays
gaagggaagguguuuuuucguc

SEQ ID NO: 6522 - RNA, 20 nt, Zea mays
ugucaugggcauauccagcu

SEQ ID NO: 6523 - RNA, 20 nt, Zea mays
cugccugguugcucugacgc

SEQ ID NO: 6524 - RNA, 22 nt, Zea mays
gcagcagggugcgccaccguag

SEQ ID NO: 6525 - RNA, 22 nt, Zea mays
augcgcguguucuugguguugg

SEQ ID NO: 6526 - RNA, 22 nt, Zea mays
ucgugguuguggcuucguuggu

SEQ ID NO: 6527 - RNA, 22 nt, Zea mays
ugguaggugaacaaguagaugu

SEQ ID NO: 6528 - RNA, 22 nt, Zea mays
ggacacugccugccgccgccgu

SEQ ID NO: 6529 - RNA, 22 nt, Zea mays
gugggcaguggcaacguacaca

SEQ ID NO: 6530 - RNA, 24 nt, Zea mays
cgaaggagcucuguucuuggcgga

SEQ ID NO: 6531 - RNA, 20 nt, Zea mays
cggcccacucaacaaccugg

SEQ ID NO: 6532 - RNA, 21 nt, Zea mays
uccagagugccgagucugaug

SEQ ID NO: 6533 - RNA, 20 nt, Zea mays
uugacgggccccuggugaua

SEQ ID NO: 6534 - RNA, 20 nt, Zea mays
gcggcuacggcaacuccgac

SEQ ID NO: 6535 - RNA, 22 nt, Zea mays
agcauggacugcggaucgaugg

SEQ ID NO: 6536 - RNA, 21 nt, Zea mays
cgcugucauugguuucgcaau

SEQ ID NO: 6537 - RNA, 24 nt, Zea mays
ggccaccgugccgcgucucaggcc

SEQ ID NO: 6538 - RNA, 22 nt, Zea mays
cucagccgccagugccaccagc

SEQ ID NO: 6539 - RNA, 22 nt, Zea mays
cccucgagguggagucgucuga

SEQ ID NO: 6540 - RNA, 24 nt, Zea mays
agcaggacgacgacgaccagcagc

SEQ ID NO: 6541 - RNA, 24 nt, Zea mays
ucggaugauagcucggaugaugau

SEQ ID NO: 6542 - RNA, 23 nt, Zea mays
acgcaugucagcuauugucucgu

SEQ ID NO: 6543 - RNA, 21 nt, Zea mays
agggcguggggaucgugcugc

SEQ ID NO: 6544 - RNA, 20 nt, Zea mays
aaaguuagugcagccuccag

SEQ ID NO: 6545 - RNA, 22 nt, Zea mays
ggcgggcaacagcaacggcgcg

SEQ ID NO: 6546 - RNA, 22 nt, Zea mays
agcgugugaucgagagguucga

SEQ ID NO: 6547 - RNA, 22 nt, Zea mays
gucgaagaccucgaagugccgg

SEQ ID NO: 6548 - RNA, 21 nt, Zea mays
cgcgcgucggcgucgccccgu

SEQ ID NO: 6549 - RNA, 24 nt, Zea mays
agguguugccauaauaugagaucc

SEQ ID NO: 6550 - RNA, 24 nt, Zea mays
caagacaccagggaucuucccaga

SEQ ID NO: 6551 - RNA, 21 nt, Zea mays
ggugauaugccuuggguggac

SEQ ID NO: 6552 - RNA, 24 nt, Zea mays
gaaguugucauucagguucuucgg

SEQ ID NO: 6553 - RNA, 20 nt, Zea mays
cuacugaacaggcaucagca

SEQ ID NO: 6554 - RNA, 22 nt, Zea mays
ccggcgggagugcggcgacgac

SEQ ID NO: 6555 - RNA, 24 nt, Zea mays
aaauacacucgggggcuugcgauc

SEQ ID NO: 6556 - RNA, 21 nt, Zea mays
gcgcgaggccgagcgcgaagg

SEQ ID NO: 6557 - RNA, 23 nt, Zea mays
ccaaaaccucuccgacagccacg

SEQ ID NO: 6558 - RNA, 24 nt, Zea mays
ccauggugaaguacuugggcgaau

SEQ ID NO: 6559 - RNA, 24 nt, Zea mays
gggggugcuuuccgccgccgcgac

SEQ ID NO: 6560 - RNA, 23 nt, Zea mays
gguguugcgguggcuacauugcg

SEQ ID NO: 6561 - RNA, 24 nt, Zea mays
auccagcgacaaauaaaaagaaac

SEQ ID NO: 6562 - RNA, 24 nt, Zea mays
gcggaucugaggcgacgauggcug

SEQ ID NO: 6563 - RNA, 24 nt, Zea mays
cagcgacaaauaaaaagaaacgga

SEQ ID NO: 6564 - RNA, 20 nt, Zea mays
ucugaagauaugcauguccu

SEQ ID NO: 6565 - RNA, 22 nt, Zea mays
uguuucugguguguugaguggc

SEQ ID NO: 6566 - RNA, 25 nt, Zea mays
cgagaacagccgcgccgagcagcgc

SEQ ID NO: 6567 - RNA, 24 nt, Zea mays
ggguuuaggcucuaggaaguucac

SEQ ID NO: 6568 - RNA, 20 nt, Zea mays
cgggccacgucgggugcugc

SEQ ID NO: 6569 - RNA, 21 nt, Zea mays
ggcagccugcucguucgggag

SEQ ID NO: 6570 - RNA, 22 nt, Zea mays
cggugauguugcggccguccag

SEQ ID NO: 6571 - RNA, 24 nt, Zea mays
ugggugggauagccgcugggugaa

SEQ ID NO: 6572 - RNA, 24 nt, Zea mays
acuagguauauacccgugcguugc

SEQ ID NO: 6573 - RNA, 24 nt, Zea mays
guuucacuacugugcuggugcuau

SEQ ID NO: 6574 - RNA, 24 nt, Zea mays
gcaccacagacgguccuaaacaaa

SEQ ID NO: 6575 - RNA, 21 nt, Zea mays
gggaugaaccgaacgucgagu

SEQ ID NO: 6576 - RNA, 23 nt, Zea mays
ggagucguacgcguggaaguggc

SEQ ID NO: 6577 - RNA, 24 nt, Zea mays
auggcgcaggagguccauggccca

SEQ ID NO: 6578 - RNA, 22 nt, Zea mays
cuugguauuuauuuagagccug

SEQ ID NO: 6579 - RNA, 24 nt, Zea mays
aguucucuucucccuacaugccac

SEQ ID NO: 6580 - RNA, 25 nt, Zea mays
gcggagucuggaugccuuaguaugc

SEQ ID NO: 6581 - RNA, 23 nt, Zea mays
ucguccuucgaagcauuaugucc

SEQ ID NO: 6582 - RNA, 21 nt, Zea mays
gcugcgcuguuggccuguugc

SEQ ID NO: 6583 - RNA, 24 nt, Zea mays
acuacuggugagucgcugcugggu

SEQ ID NO: 6584 - RNA, 21 nt, Zea mays
gcgguggugucaugcccaaca

SEQ ID NO: 6585 - RNA, 23 nt, Zea mays
ggcuaaaugugccacacuuuguc

SEQ ID NO: 6586 - RNA, 24 nt, Zea mays
gcggaugucgucgguccgcgugca

SEQ ID NO: 6587 - RNA, 20 nt, Zea mays
uggagagccucucuaaggag

SEQ ID NO: 6588 - RNA, 24 nt, Zea mays
gaguuuagagugguucgggccgcc

SEQ ID NO: 6589 - RNA, 21 nt, Zea mays
agccagugguucguggugacu

SEQ ID NO: 6590 - RNA, 22 nt, Zea mays
cgggaguucagggacuuguucg

SEQ ID NO: 6591 - RNA, 21 nt, Zea mays
gggugcgggaagccaccggcg

SEQ ID NO: 6592 - RNA, 23 nt, Zea mays
gcugcuccacccagaguuuuaga

SEQ ID NO: 6593 - RNA, 24 nt, Zea mays
cacaggcacgauuggccuugcccc

SEQ ID NO: 6594 - RNA, 20 nt, Zea mays
ugauaaacuaguugcuggcg

SEQ ID NO: 6595 - RNA, 21 nt, Zea mays
gcuguccgccguacgaagucg

SEQ ID NO: 6596 - RNA, 22 nt, Zea mays
ggacuggugcauguauggucua

SEQ ID NO: 6597 - RNA, 20 nt, Zea mays
cgccccgcugcuccugccgc

SEQ ID NO: 6598 - RNA, 24 nt, Zea mays
ggaaggugugaagaucauggaaaa

SEQ ID NO: 6599 - RNA, 25 nt, Zea mays
ggaucagggagugccgguccuaccc

SEQ ID NO: 6600 - RNA, 20 nt, Zea mays
agauggaugcuggugacucu

SEQ ID NO: 6601 - RNA, 24 nt, Zea mays
acuauuaguucuagugcauucaaa

SEQ ID NO: 6602 - RNA, 21 nt, Zea mays
acgcugguacugauuuccucc

SEQ ID NO: 6603 - RNA, 20 nt, Zea mays
acugcaagugcgaccccugc

SEQ ID NO: 6604 - RNA, 22 nt, Zea mays
gagugcaugaucgaaggcucga

SEQ ID NO: 6605 - RNA, 25 nt, Zea mays
cccuguacugcagaacaguucuuca

SEQ ID NO: 6606 - RNA, 24 nt, Zea mays
agcgucggcguuaucaagcagugc

SEQ ID NO: 6607 - RNA, 21 nt, Zea mays
ggcaaaugcacaaggguuggc

SEQ ID NO: 6608 - RNA, 20 nt, Zea mays
gcggcggcuaccggaucguc

SEQ ID NO: 6609 - RNA, 21 nt, Zea mays
uggugggguacugugcucucg

SEQ ID NO: 6610 - RNA, 24 nt, Zea mays
cggcgucaagauguauggugcuga

SEQ ID NO: 6611 - RNA, 21 nt, Zea mays
gccgcugcagcuugugucucu

SEQ ID NO: 6612 - RNA, 24 nt, Zea mays
aggaggccgagcugaacaggcgug

SEQ ID NO: 6613 - RNA, 24 nt, Zea mays
acacgggagcugcagcccgggagc

SEQ ID NO: 6614 - RNA, 25 nt, Zea mays
gcagcucgccgagcccucuuccuga

SEQ ID NO: 6615 - RNA, 20 nt, Zea mays
gaguugccugaucugugaga

SEQ ID NO: 6616 - RNA, 24 nt, Zea mays
ucacuaaccuugcaggacccaaca

SEQ ID NO: 6617 - RNA, 24 nt, Zea mays
caucaugcgccccaucuggucccg

SEQ ID NO: 6618 - RNA, 22 nt, Zea mays
cccuagcagcgcgcggcaucgu

SEQ ID NO: 6619 - RNA, 20 nt, Zea mays
gcggcuaccucggccugacc

SEQ ID NO: 6620 - RNA, 21 nt, Zea mays
gcgccgccgccgucguccucg

SEQ ID NO: 6621 - RNA, 20 nt, Zea mays
ggcuucgccgagugcuuccg

SEQ ID NO: 6622 - RNA, 25 nt, Zea mays
acggcgaacuccgcucugcccgacc

SEQ ID NO: 6623 - RNA, 20 nt, Zea mays
ggcguucagguucucgcgga

SEQ ID NO: 6624 - RNA, 21 nt, Zea mays
aggucauauguccuuggauaa

SEQ ID NO: 6625 - RNA, 22 nt, Zea mays
cagcaacagcagcuugccgcgg

SEQ ID NO: 6626 - RNA, 24 nt, Zea mays
ccugcgagaccugcaccaagacca

SEQ ID NO: 6627 - RNA, 22 nt, Zea mays
caagucagcgugaacaguacgg

SEQ ID NO: 6628 - RNA, 21 nt, Zea mays
gcgcccgccccugguccgagc

SEQ ID NO: 6629 - RNA, 22 nt, Zea mays
aggccaagcuugaggcugccaa

SEQ ID NO: 6630 - RNA, 22 nt, Zea mays
ucauaaugaucugcauagguua

SEQ ID NO: 6631 - RNA, 22 nt, Zea mays
uccguucucgaauauuugucgu

SEQ ID NO: 6632 - RNA, 20 nt, Zea mays
cgcggacaacacgggcgcca

SEQ ID NO: 6633 - RNA, 21 nt, Zea mays
gcgacguuccggcgcaucgug

SEQ ID NO: 6634 - RNA, 22 nt, Zea mays
ugcuauggucauaucuuguguc

SEQ ID NO: 6635 - RNA, 23 nt, Zea mays
cauagggauugagggggauugga

SEQ ID NO: 6636 - RNA, 24 nt, Zea mays
ggcacgaaggaauucauggaggca

SEQ ID NO: 6637 - RNA, 21 nt, Zea mays
ucuggauuggucuaaacgaac

SEQ ID NO: 6638 - RNA, 21 nt, Zea mays
gugauccgagagagccgggua

SEQ ID NO: 6639 - RNA, 21 nt, Zea mays
uggauuaucauaaucuaggua

SEQ ID NO: 6640 - RNA, 24 nt, Zea mays
gcaccguacggucaagugcgcagu

SEQ ID NO: 6641 - RNA, 21 nt, Zea mays
ugaagagccaaguagaacgga

SEQ ID NO: 6642 - RNA, 22 nt, Zea mays
cccacaggaagaugaccggcgc

SEQ ID NO: 6643 - RNA, 24 nt, Zea mays
acuauuagcucuagugcauucaaa

SEQ ID NO: 6644 - RNA, 21 nt, Zea mays
ucagugcaaucccuuuggaau

SEQ ID NO: 6645 - RNA, 21 nt, Zea mays
uccaaagggaucgcauugauc

SEQ ID NO: 6646 - RNA, 20 nt, Zea mays
uaagugcaguaccucaugca

SEQ ID NO: 6647 - RNA, 21 nt, Zea mays
ugccaaaggagaguugcccug

SEQ ID NO: 6648 - RNA, 21 nt, Zea mays
ucgcuuggugcagaucgggac

SEQ ID NO: 6649 - RNA, 24 nt, Zea mays
caugguugcuggagugacuuggcc

SEQ ID NO: 6650 - RNA, 22 nt, Zea mays
uaccuuaccgcaucuaggcccg

SEQ ID NO: 6651 - RNA, 21 nt, Zea mays
ucggaccaggcuucaaucccu

SEQ ID NO: 6652 - RNA, 21 nt, Zea mays
gcuaucuucggaugccugagg

SEQ ID NO: 6653 - RNA, 21 nt, Zea mays
ugccuggcucccuguaugcca

SEQ ID NO: 6654 - RNA, 24 nt, Zea mays
agccuuacccgcauaauaugcaga

SEQ ID NO: 6655 - RNA, 21 nt, Zea mays
ugaagcugccagcaugaucug

SEQ ID NO: 6656 - RNA, 24 nt, Zea mays
ucacucauuuuggugcaagcgugc

SEQ ID NO: 6657 - RNA, 21 nt, Zea mays
ucggaccaggcuucauucccc

SEQ ID NO: 6658 - RNA, 24 nt, Zea mays
cgcauacaacgacggacgguccgc

SEQ ID NO: 6659 - RNA, 21 nt, Zea mays
ugcaguuguugccucaagcuu

SEQ ID NO: 6660 - RNA, 24 nt, Zea mays
cgggagcgaauuuucaggcuuggu

SEQ ID NO: 6661 - RNA, 25 nt, Zea mays
gaaggugucguccuugaguugcuuc

SEQ ID NO: 6662 - RNA, 24 nt, Zea mays
caucggguagcggguauggggcaa

SEQ ID NO: 6663 - RNA, 22 nt, Zea mays
auugcaacugcugucuggugua

SEQ ID NO: 6664 - RNA, 24 nt, Zea mays
ugagagccgccgucgucacagggc

SEQ ID NO: 6665 - RNA, 24 nt, Zea mays
acaccagcagcaccuccacaucaa

SEQ ID NO: 6666 - RNA, 21 nt, Zea mays
cgcgcuuggggucgacuuggc

SEQ ID NO: 6667 - RNA, 23 nt, Zea mays
gaggcccgugagcccggcacgaa

SEQ ID NO: 6668 - RNA, 22 nt, Zea mays
caagggugagcucacuuauggu

SEQ ID NO: 6669 - RNA, 24 nt, Zea mays
agccccaagguagcuaggagccgu

SEQ ID NO: 6670 - RNA, 24 nt, Zea mays
agagcagcccccgagccucugcac

SEQ ID NO: 6671 - RNA, 22 nt, Zea mays
cgccgccggccgccgccucguc

SEQ ID NO: 6672 - RNA, 24 nt, Zea mays
guagauaauuaugcaauucgguau

SEQ ID NO: 6673 - RNA, 24 nt, Zea mays
acacauggauuggaugagauugga

SEQ ID NO: 6674 - RNA, 24 nt, Zea mays
gacgaccacggagauauagagagu

SEQ ID NO: 6675 - RNA, 21 nt, Zea mays
aagccggagcuguucgagccu

SEQ ID NO: 6676 - RNA, 24 nt, Zea mays
acuauuaucucuagugcauucaaa

SEQ ID NO: 6677 - RNA, 24 nt, Zea mays
cggaggugggcgccaauguugggg

SEQ ID NO: 6678 - RNA, 24 nt, Zea mays
cggacacuguccggugugcaccgg

SEQ ID NO: 6679 - RNA, 22 nt, Zea mays
cgccggugagcucauccgcucg

SEQ ID NO: 6680 - RNA, 21 nt, Zea mays
ugcaguugcugccucaagcuu

SEQ ID NO: 6681 - RNA, 24 nt, Zea mays
agacaaggacaggugcaugugggc

SEQ ID NO: 6682 - RNA, 24 nt, Zea mays
acgaacuaaggaucgucggcgcca

SEQ ID NO: 6683 - RNA, 22 nt, Zea mays
acgccaccgacgccuggcugug

SEQ ID NO: 6684 - RNA, 84 nt, Zea mays
ggcuccgauucgcuuggugcaaggcgggauccgucccgucggccgggcggcgggucccgaucugcaccaagcgagcccgaggcg

SEQ ID NO: 6685 - RNA, 101 nt, Zea mays
ugugacuaugguguuggcucggcucacucagaaguugaagccgaaucuaaaugguagcugccggcguuucugauugagccgugccaauaucucaguacucu

SEQ ID NO: 6686 - RNA, 234 nt, Zea mays
ggauuugaagcggagcuccucucauuccaaugaaggguccguccgaagggcgguuccgcugcucguucaugguucccacuauccuaucucauccauguuugugugucuucgagaggaagcggagagauuccuguggucgccuuuugagauaggcuugugguuugcaugaccgaggagcuccgcccacccccugauggccgcucuuuggauugaagggagcucugcauccugauc

SEQ ID NO: 6687 - RNA, 219 nt, Zea mays
ccgcggguccgggccacgcccacgcgcgacgugaccuuuugcuguuuggcacguuccuuuucacagcugcccagugccuguacgcgccgagauccagagccaggauggucagcaugggucugcugaaggaaggcgucaacauggacgagggaacccuauagaucggaauggaguacaggacugugucugguguggccgggccucugguuauuuuggaua

SEQ ID NO: 6688 - RNA, 146 nt, Zea mays
ccagacaacaguugcaaucauuguuuuguuuaacagauuuuuggacauaguuauauaggaguugcaaucacaccagaccagcaguugcaaucacaccagaucagaaguugcaauuacaccagacagcaguugcaauuauuguuugu

SEQ ID NO: 6689 - RNA, 103 nt, Zea mays
uucuuugaugcucaucgacguuggacuccauucaagcaugauuucaggaauucgcuuacugcauucagagguggagccaaaaucagaaaugggccaccaaaga

SEQ ID NO: 6690 - RNA, 93 nt, Zea mays
cuuagguucuuugccgaguguuaugucgcuggcacucggcaaagaggucggcuuugccgagugccgcacagaacacucggcaaagagccugac

SEQ ID NO: 6691 - RNA, 122 nt, Zea mays
cugaugaauauggcuuugguucuguagccaugauagcuacuggaugugucauggcacggauuugucacacaaauaauuguccaguuggaguggcuagucagagagaagagcuucgugcaagg

SEQ ID NO: 6692 - RNA, 163 nt, Zea mays
cuccuagcacacgccuuucgccucuuccuccugaaccugccgacuucuacaacgacuucgcuaccccaguggauauccccauggacacaaacaaggacaugaagacaagggagaaggagcuucuggccaaggaggccgagcugaacaggcgugagaaggaaau

SEQ ID NO: 6693 - RNA, 170 nt, Zea mays
ggcgcgcccacgccgucgucguccacgccgccggcguacgggagcaucgucaccgugcucagcaucgacggcgguggcgugcgcgggaucaucccgggcaccauccucgccuuccucgaggagaagcugcaggaguacgacgagcggccggacgcgcggcucgccgacua

SEQ ID NO: 6694 - RNA, 164 nt, Zea mays
ggccaaccaguggcgaagcuagaguaaaauagaggaggguguaugguaauaaccgguagaggguacauauaugguaaaaaucugguaugaaucacuaauuuuguaaaauuucgugggugcauaugcaccccccuaccuucuaccuagcuucgcccuuguggcca

SEQ ID NO: 6695 - RNA, 90 nt, Zea mays
  misc_feature (56)..(56): n is a, c, g, or u
uacuacucccuccguuucuuuuuauuugucgcuggauaguguaaaauugcacuauncagcgacaaauaaaaagaaccggagggagucguu

SEQ ID NO: 6696 - RNA, 65 nt, Zea mays
cugaccaacgcgacuggucgacugcuagcccguagcugcgcuguuggccuguugccaugccauau

SEQ ID NO: 6697 - RNA, 63 nt, Zea mays
gccaccaaccggcagcucagcgugacgcaccccgugcacaggcugcugcugccgcacuaccgc

SEQ ID NO: 6698 - RNA, 99 nt, Zea mays
ugucuuguccacgccagcacgcguucauggucgcgucggccaaauucaccaacguucuauuaccaauucgacuaucaucgcuguugcgugcgcucgcgc

SEQ ID NO: 6699 - RNA, 108 nt, Zea mays
auugauauuacauguguauuggaguguauugagugggauugugauguauuuugacuuguuauggauuuaaaccggcucaauaccacccgauacauguggauuaucccc

SEQ ID NO: 6700 - RNA, 71 nt, Zea mays
uuaaaguccuucguccuucgaagcauuauguccccuucgggaaauaaugagucugggacgaaggucauaag

SEQ ID NO: 6701 - RNA, 80 nt, Zea mays
agucgaccagcugccaccaacgcguaccaaggaccagcucauggagagguacuggucgcacguggugcagugcaggagcu

SEQ ID NO: 6702 - RNA, 81 nt, Zea mays
ccgccgcgcaggccaccgucguccucggcguggccccggagaagaaggccgcgcccgaguucgucgaggccgcggcggagu

SEQ ID NO: 6703 - RNA, 161 nt, Zea mays
aaggugacacugcaaagcuugagauucagauuaaguuggacaaagagaagaaaauccucuccauucgggauagggguauugguaugaccaaggaggaucuuauuaauaaccuuggaacgauugcuaaaucuggcacuucagcuuuuguggaaaagaugcag

SEQ ID NO: 6704 - RNA, 73 nt, Zea mays
ggagacaaagacgcaugucagcuauugucucguuuucuaagcaacgagcgagagcugcaugcgcugguuagau

SEQ ID NO: 6705 - RNA, 65 nt, Zea mays
acuccuccugaauaauguaggcgcagugacagcagcacugccguucucuuuauuuuucaacacua

SEQ ID NO: 6706 - RNA, 304 nt, Zea mays
uagaagcaaaucugaagauaugcauguccucccucccuggcuguagauugauugucaguagggcaucccacaccucaagaaaaucagacaguaccccuacugucaaugccccuuugauaucagucagccacuuucugucugagaacuguccauacagcucuagcaaauagaaguuggcugaaugacaucaaaggagcucucauuguggaaguccuugcugauuuucuugaucuuugggaugcaauucucacaguaaacuuaaauccucaaauggaggacaaacacaucuugagaugcucauaau

SEQ ID NO: 6707 - RNA, 195 nt, Zea mays
guagagggagaggagugcccggacugcggugggacuagccucuguggccgcugcaaaggagagggcuucgucuucaaguagcucucgaaggauaugaccaccagggaacacaaggucgccaagaacauggccaccaaauacacuuuaggcuguccaccauuggaccuacugcaacaagugcuccuccacccgcgu

SEQ ID NO: 6708 - RNA, 103 nt, Zea mays
gaaagaggcugacagaaagagaagugagcacgcggcgaggacggcauacaugcuauguccgucgucgcgccgugugcucacucucuucugucaaucucucgag

SEQ ID NO: 6709 - RNA, 228 nt, Zea mays
ucaagcuaucguccaguuccucuugcucagcaguacauuaggaucagugaaagggauuacacaaagagaagugaauuauucaauacuuuguguuaugagaagguuguuaaguccauuaagcaaggucaccaagcauugguuuuuguccauacccguaaggauacugggaaaaccgcuagaacccugauugaccuagcagcaaaagcaggggaauuggaauuauuuuca

SEQ ID NO: 6710 - RNA, 117 nt, Zea mays
ucuggaaagcaucagcauguucuucggccuguugagaagccacaugggaaugaugguaucuugugugcaccaguuaagccaccagugccgaaugagcacucugauggagccaugccg

SEQ ID NO: 6711 - RNA, 135 nt, Zea mays
cgggcgucgucaccuccagcgugucggagucgucggcugggcucccggcgggccccuccugccagagggcggcugccgcgccgugugcacgggaggaccacccacgaugccgcgcgcugcuagggcggcguucgu

SEQ ID NO: 6712 - RNA, 67 nt, Zea mays
guaccaccuccaaguccuggguucgauuccuaucgggagcgaauuuucaggcuugguuaaaaauccc

SEQ ID NO: 6713 - RNA, 86 nt, Zea mays
uuaacaccucugacaucauuagcugcagcagaucuugcucuucaagcuggaauaccagcaggugcacuaaauguugugaugggcaa

SEQ ID NO: 6714 - RNA, 74 nt, Zea mays
gguacccaagguuuaugcauccgggggcucaaguuggaucauugauagcgggugcacaaaccacaugacagggg

SEQ ID NO: 6715 - RNA, 91 nt, Zea mays
gaccccgucgagcgcuugaaggacggguuccacaaguucaagaccgaggucuaugacaagaagccggagcuguucgagccucucaaggccg

SEQ ID NO: 6716 - RNA, 83 nt, Zea mays
gagugcccaugcguugcaacgaggauauauaauaucacgguaacuuauauauuauaugucuccguugcaacgcacggacacuc

SEQ ID NO: 6717 - RNA, 211 nt, Zea mays
uaagggggcguuugaaugcacuagaacuaauaguuaguggcuaaaauugguugagacauccaaacaccuuagcuaauaguuuagcacuuuagcuauuagcuauuauugguaaauuaguuaauaguuggguaguuauuuguuagcuagcuaauuccacuaacaauuuuuagccaacuaacuauuaguuauagugcauucaaacacccccuaa

SEQ ID NO: 6718 - RNA, 85 nt, Zea mays
uuuguaaaagcucaugugccucuaccucuggcaaggcuucucacaccucuacggcagcagguggcagccacugugugaugugcau

SEQ ID NO: 6719 - RNA, 71 nt, Zea mays
cccuuguuguuauaaaacuuuuaucacuuauauguugcauuaggugauaggaguugugugaauaaacaauu

SEQ ID NO: 6720 - RNA, 67 nt, Zea mays
gaggugacaagagauguaugcuugcuggccagaaugauggcugcaaacuuguacaucgaucagauug

SEQ ID NO: 6721 - RNA, 63 nt, Zea mays
aggucacgguuucgaagcagccucuccgcauuugcgugggaggcuugccucgguuuaucccuu

SEQ ID NO: 6722 - RNA, 77 nt, Zea mays
gccucucucucuccucccuucucccacccaccccucucucuugcugugggugugcuguggagaggagaaaggaagua

SEQ ID NO: 6723 - RNA, 90 nt, Zea mays
aauacuccauccgauucuuuauagcuguagcuggauagaccauauccucuaucuauccagcgacaacuaaaacgaaacggacagaguaag

SEQ ID NO: 6724 - RNA, 214 nt, Zea mays
augacuggagcuggacgacgccagagagcaguaggguuuacgccugaacaaaggcugguggcuggcagguuuuguguuaggcugggguaggguuucggcugaccaggggcaacauauauguugcaacuguagaugggcugaaaaaaugaguuaagcccauuagcccaguauaaacgccucuguucuuaaggcgucgccuaggcguccaagcggu

SEQ ID NO: 6725 - RNA, 127 nt, Zea mays
caguuccggcgggggcggacugggaacacaugggaaugagaugagaucauugcucggucgugcuggccugggccgucggcgcgcguugaucuugcauguguucucaggucgcccccggagggccuuc

SEQ ID NO: 6726 - RNA, 170 nt, Zea mays
gaaccaaacuggaauccucuuauuuuugaaaccuuuuuaauuauguucuaauugaggugguuuuguccguggauggucaugccauucuucaugggugauaaccagggcagguccacuuaucagaacaaauugaaccggugaucagaguugaugaggauacagucgaauga

SEQ ID NO: 6727 - RNA, 130 nt, Zea mays
cgccggcaagcagcuggaggauggccgcacccuugcagacuacaauauccagaaggagagcacccuccaucuggugcuccgucuccgcgguggucaguaagccgugggucguuuaagcugccgcuguacc

SEQ ID NO: 6728 - RNA, 232 nt, Zea mays
aagguuguugagguugaugcucuugcuaaggcauuggcuggucaaaaggaugaggcuuacuucgcagcaaaugcugcugcucaggccucgaggaaauccucaccccgugugaccaaugaagaaguccagaaggcugcugcugcucucaagggcucugaccacccgccgugcgaccaacguuagugcuagauuggaugcccagcagaagaagcuuaaccuccccauccuuccc

SEQ ID NO: 6729 - RNA, 61 nt, Zea mays
ugagcgaguacaagucagcgugaacaguacgggcguacuguucaucuauuuauaggcacag

SEQ ID NO: 6730 - RNA, 244 nt, Zea mays
ggcggcggcggcggcggcggcggaggcggaggcaguggcggugcgaacguggcuaacguggucagcgacgcguucuucaacggcaucaagaaccaggccgggagcgggugcgagggcaagaacuucuacacccggagcgcguuccugagcgccgucaacgcguacccgggcuucgcccauggcgggacggagguggagggcaagcgcgagaucgccgccuucuucgcgcacgucacgcacgaga

SEQ ID NO: 6731 - RNA, 98 nt, Zea mays
ccaggggaaucccugcgagaguacauccgacgguuuucaaugcagcgcgccgagcugcccaacaucaccgacucggaugucaucggggcguuccucgc

SEQ ID NO: 6732 - RNA, 73 nt, Zea mays
ugcuguuuuugcgcagugaacagcacgccgucgacgcucgucgaguguuugcuguuuuugcgcagccccaaca

SEQ ID NO: 6733 - RNA, 78 nt, Zea mays
ccaugagcagcacgccggggcucccgggcccgccgaggaacuugugcgggcugaggaacacggcgucguagccguccg

SEQ ID NO: 6734 - RNA, 88 nt, Zea mays
cucggccguuaccugaugguugguggugagugugcuuggcaucgccuguguucugucuuugccgcuguaccauuuuggagacgcuuac

SEQ ID NO: 6735 - RNA, 237 nt, Zea mays
ugguggcaccaagcaugaggcaggaacugcauuacuugcaagaaagucacaagcucauuccaaucugauucucuaaacuuuggaggucucuuacaccuaggccugaaagcuccucucccauuaguugccuacaacauuggaaaagaguuucucacauuaucuuagaauccauugcaagaucauacuuguggcuuucuugcaaguugugcaguuguugccucaagcuugcugccuccc

SEQ ID NO: 6736 - RNA, 65 nt, Zea mays
auaugcccgugcguugcaacggagacauauaauacauaaguccccguugcaacgcaugggcacuc

SEQ ID NO: 6737 - RNA, 118 nt, Zea mays
aagaagaaaacugaagcgucuucaucguccaaucaugcgguugccucugguccggcuaaggucuggcaaccggguguagaugcacuggaagauggggaggagcuucaguuugauccug

SEQ ID NO: 6738 - RNA, 70 nt, Zea mays
gggccgcuggcgaaccccagccgccgggcgcuggaucgggccucgggcugugggauuggugcgguggcuu

SEQ ID NO: 6739 - RNA, 185 nt, Zea mays
gcgaggucgucgacccgcucuaccccggcggcagcuucgacccgcucggccucgccgacgaccccgaggccuucgccgagcucaaggucaaggagcucaagaacggccgccucgccauguucuccauguucggauucuucguccaggccaucgucaccgggaagggcccgcucgagaaccucgcu

SEQ ID NO: 6740 - RNA, 104 nt, Zea mays
cauggcguugugccuggcucccuguaugccacacauauauagacugaucugaacugagauuggcuacuguggguggcgugcgaggagccaagcauacccucucu

SEQ ID NO: 6741 - RNA, 73 nt, Zea mays
aggcucccaugccucaggauaacgagggcuacauuuuguacccugccggcuauccugagagcaaaauaaggaa

SEQ ID NO: 6742 - RNA, 384 nt, Zea mays
ucauuugagucggcccacucaacaaccuggugcccagacuguuggugguacucaagaaaaugaccaacccaaacauggcucagcugcugaggcaagggaaggaucgccagcucagcaaaaugagaacagugaaaauacaacgaauccuguagaucugucagaaagugcuggcccugcaccuccugauagugaugcacuucaaagaguuguguccaaugcaaguauugagcaugcuacggagaugcaguaugaacgcagcgacacuauaacacgugauguugaagcagugagccaagcaagcaguggcaguggugcuacuuuaggggagagccucagaaguuuagagguugaaauaggaaguguugaagggcaugaugaugguga

SEQ ID NO: 6743 - RNA, 90 nt, Zea mays
aauuacucccuccguuucuuuuuauuugucgcuagauagugcaauuuuacacuauccagcgacaaauaaaaagaaacggagggaguacuc

SEQ ID NO: 6744 - RNA, 79 nt, Zea mays
gaaguggcgcuugauguggaggugcugcugguguagucguacucauguugcaggugauguccucaucaauaaccuuggg

SEQ ID NO: 6745 - RNA, 59 nt, Zea mays
aaccugcuuauggauuaucauaaucuagguaucuagauuauauaauccaccuaauaauc

SEQ ID NO: 6746 - RNA, 73 nt, Zea mays
gggauccaugggggaggaauccccuugcaauucaauuuugaauagcaagaggauuucuuccccucgggaucac

SEQ ID NO: 6747 - RNA, 238 nt, Zea mays
aguguauggaccgaagaaccugaaugacaacuucugguugacccguucagugauagaagacugacaguagggcuguaauuugaggaacacccgaucccccacugcaaacacucuuucaguccuaccucgaucugcuugcuucuucauucgguccugggcacgcuggagaugcaagcguaccugcuguaacaugcccugccggucuuggagguauuguuucaggucugggacagaacac

SEQ ID NO: 6748 - RNA, 99 nt, Zea mays
uaguuaguacucccuccaguuucuuuuuauuaggcgcuggauugaucaauuuuaaaccauccaucgacuaauaaaaagaaacggagggaguacuacuuu

SEQ ID NO: 6749 - RNA, 112 nt, Zea mays
uuggauacuuugggauugaaguguuuucaagggauuggagaggguguaaauccccaauagaucaaauacucucucaauacaucuuaauucacuccaaucccacucauuacua

SEQ ID NO: 6750 - RNA, 240 nt, Zea mays
cugaaugugcagcuaaguuggcaccucuuuuauuacagaaggguguccucaggacaaauugcauagacugcuuagaucgcacaaauguugcacaauuugcauaugguuuagcugcuuuagggcgucaacuucaugcauuggggcuuacugaagcacagaaaauugaauugcacgauccucuggcugaugaucugauggacuucuaugaauggaugggugauacauuagcuauucaguaug

SEQ ID NO: 6751 - RNA, 225 nt, Zea mays
ccaguagagagagagagguguaccugagucguucccagcagagagcggugaggagagcgggcugggaacggagccgcuccguccccucaauuuuuuggagugggaugguuccagaucuggagagaauauucucuaauuggagcgacuccguucuaguuucuugcuaaccaaacagcaccaaaacuaggacggaacgauuccguucuacuuggcuccucaaccaaa

SEQ ID NO: 6752 - RNA, 69 nt, Zea mays
uccugccgccggcggaggcagaggagucuccuccgggggucauccuacggccuccgccgccccccgagg

SEQ ID NO: 6753 - RNA, 109 nt, Zea mays
aagauuagcuuguucgguuacauuaauccaaaagagaauugggggagaauugguuacaucaaucaaccaauccuauuaugaauugguguaaccgaacaaaccauaagug

SEQ ID NO: 6754 - RNA, 75 nt, Zea mays
cgaggccaggugccacgccaccgucguuucaggaugguucacugaaccgcgaucgcgcuguggcaaagccagcaa

SEQ ID NO: 6755 - RNA, 132 nt, Zea mays
cacauggcagccauacaacgcaccugaguaugcugggaugaucuuuaguguaguaugcagcagugaagaugaaaucuauaugaugcaauguccuuuggucuguuucugguguguugaguggcaccuaccuca

SEQ ID NO: 6756 - RNA, 75 nt, Zea mays
cucccaacugaugagacucuuguggcccagaucaaggaaggguuugaaagcggcaaggaucuuguugugacuguc

SEQ ID NO: 6757 - RNA, 73 nt, Zea mays
cugaaauggcucgacgaugcgcugacuucgaggagaaguauucucaaagucagaucgaguugagucaggucuc

SEQ ID NO: 6758 - RNA, 233 nt, Zea mays
gcggacuacaccgccaggacgucguucgagcggccgcugcugagcgggguggcguacgcgcagcggguggugcacgccgacagggagggcuucgagcgccaccagggguggaucaucaagaccaugaagcacgagccguccccggcgcaggacgaguacgcgcccguuguauacucgcaggagaccgucuccuacaucgaggggcucgacaugauguccggcgaggaggaccg

SEQ ID NO: 6759 - RNA, 73 nt, Zea mays
uucgaucaaagccaggggagucacguccguugaauuaaccaucgggacugagacccuugcugcugcauucuuc

SEQ ID NO: 6760 - RNA, 156 nt, Zea mays
ccacgccgucccggaggcuccggaagugccgcgagauggugcgcgacgccagcgccguguacgccgccgccgcgcgcuccccggccaccgccucgaacccgcccgccagcgcccgcaucugcucgcaguaccgccgguaucuccgguccaccucuu

SEQ ID NO: 6761 - RNA, 174 nt, Zea mays
gguucucuacuuauccaaggacauaugaccuuauacauucuaauggcaucuucagcuuguaccaaaacaaaugucaguuugaagauauacuccuggaaauggacagaaucuuacgcccggagggugcagucauaauucgugacaagguugauguucuuguaaaaguggagaaaa

SEQ ID NO: 6762 - RNA, 113 nt, Zea mays
aguuccaguuugaucauaggcaccuaggucgaugcucuuuaguaagauguaaguaaucugucuucuggccagguugagcaaggcuuagcugcaguguaucagugugguacaac

SEQ ID NO: 6763 - RNA, 76 nt, Zea mays
uuggugagagcguaggugcuggccccgagcacgauggccguguugaugccccgguccagcaucuuguugccgccgc

SEQ ID NO: 6764 - RNA, 185 nt, Zea mays
gagcggcgucggcguggcgucgaugggugugaugcggccggagcucgucaugaaguccaucgugcccguggucauggcuggugugcucgguaucuacgggcucaucaucgccgucaucaucagcacugggaucaaccccaaggccaagcccuacuaccuuuuugauggcuacgcucaccuuucgu

SEQ ID NO: 6765 - RNA, 65 nt, Zea mays
cccagacuaugauccgagcaccgagccuaucgaccccgaugugcucaugagggucggaggaggca

SEQ ID NO: 6766 - RNA, 72 nt, Zea mays
cggccaggggcuucuccuucccauuugcucuagcgacaccgucgagacggcaguggcgguggccccaggccc

SEQ ID NO: 6767 - RNA, 223 nt, Zea mays
gcguuccgccgaccaaguuuugggcucuguugauggcacugaauugguuccuucugguucauugcgagcugcuucggguggugacccuaugccaggcauugguggacgggauggcuagucagcugagguugcaagguguuucuguuccagaaggagcuucgucucuugcgcguuggaauccggugcugcuucagcagcgugucucugacuuggaggcggcgaa

SEQ ID NO: 6768 - RNA, 63 nt, Zea mays
gucguuggcuguaaugaaaagcugggccugcuagagccaggaguuuucguugcaaaucugcgu

SEQ ID NO: 6769 - RNA, 131 nt, Zea mays
gcacaucaagguugugagagaagguuuggagccacaggaguuuugggaugcauuuucaaguacgcugccuaauucagauacuaauacaaagauuagcaaggaccagaucgauucagcauccaagaguaacc

SEQ ID NO: 6770 - RNA, 70 nt, Zea mays
uguugugugggugccgcacgcuagcaggcuagccaugugcccugcuguguugugucaccauccaucuaua

SEQ ID NO: 6771 - RNA, 64 nt, Zea mays
uuguucaugcugccauguaggugacgagcucacgugugcuccugccuaugggcgaucugugucc

SEQ ID NO: 6772 - RNA, 106 nt, Zea mays
gugcgggccggcggcugcacccuccuguugaggcagucgugggcgucgcaguacaucccugccguccucgcguccucgaacaagggguggcagcgccggugguucu

SEQ ID NO: 6773 - RNA, 73 nt, Zea mays; identical to SEQ ID NO: 6704

SEQ ID NO: 6774 - RNA, 177 nt, Zea mays
gggaauccucgggcggcacugcagcgucgaccggccgcaucgucgucuucucgagugcgugaggauacgugucauccgaagagcaaguugguaccuggaaucucaagucccaggucaagagcagguaccacaggaugaggcgcauggaggaugcugcgaugaguucgugagagaucu

SEQ ID NO: 6775 - RNA, 104 nt, Zea mays
ggugcaggacuccaaagggaucgcauugaucucuucucaccugccgccugcugcaugcgcugcgcguugccgcacaagaucagugccaucccuuuggcauuuuc

SEQ ID NO: 6776 - RNA, 133 nt, Zea mays
accggagaccauggcggaccagcucaccgacgaccagaucgccgaguucaaggaggccuucagccucuucgacaaggacggcgacgguugcaucacaaccaaggagcucggaacugucaugcgaucacugggu

SEQ ID NO: 6777 - RNA, 78 nt, Zea mays
gcgcggcggacgcugcggcgcucugcagccccugcgacaccgcugugcacgcugcgaaccugcuggcgucgcgccacg

SEQ ID NO: 6778 - RNA, 200 nt, Zea mays
gggcaugcuuuccacaggcuuucuugaacugugaacucgugggugguggugguaugucggauggaaugcuuggcuccucccagcuagcaauucucuucccccaugcaccggccgugaauugagcugcggagcuuccccgcagccucgcucggccggcucuaccuguugaugguucaagaaagcccauggaaaccaugcag

SEQ ID NO: 6779 - RNA, 62 nt, Zea mays
gcaacaacaugguggagcaggagcugccuggaggcgggcuccucguguaccagagcuucugu

SEQ ID NO: 6780 - RNA, 71 nt, Zea mays
caucccucugcacgcauggaacgaugccaucgccaagcgugcgguggcuaaguccugugugcuggacuacg

SEQ ID NO: 6781 - RNA, 87 nt, Zea mays
uggcggagggcacgucugccugggcgucacgcacggcaacuugugcgaccgccggcgccgacgccccaaggcaggugcccugugacc

SEQ ID NO: 6782 - RNA, 71 nt, Zea mays
cgucgcgccgucccgcgccgagccgccgccgggcagcuacggcggcuaccucggccugaccaacgcgacgc

SEQ ID NO: 6783 - RNA, 86 nt, Zea mays
uuuucuuccugugcacaccacugauaaggcucagaaguaugcagaauuguauauugaccggaucguguguuugcacggauuaccuc

SEQ ID NO: 6784 - RNA, 81 nt, Zea mays
gagagauggcgagaguagcuuguacccucuguggcaagagacuggaagguggggugcuguacucucggaaacauggcgggc

SEQ ID NO: 6785 - RNA, 121 nt, Zea mays
gggucagagaccagcugaacugccccucaggaccaguucaacuggucuugaccagagaguuuaggagagaaaaccccagcucaacugcccggaggcaaguucagcugguguauggucaaag

SEQ ID NO: 6786 - RNA, 70 nt, Zea mays
uggugcuaccgcagccgcagcuacgacgccacguacgagggcuucgugcucccgcugcgcgucaccgcgg

SEQ ID NO: 6787 - RNA, 65 nt, Zea mays
ggcugguuaguggagcuauugcaggugcuguuuccaggacuuguguggcaccacuggagacgauc

SEQ ID NO: 6788 - RNA, 107 nt, Zea mays
cuccacuugaggggaaugaagccugguccgagaucgacaagaaccuagaccgaugagaucugcauguuucugcaccucgagccagacaacauuccccucaaaguaag

SEQ ID NO: 6789 - RNA, 161 nt, Zea mays
aaggugacacugcaaagcuugagauucagauuaaguuggacaaagagaagaaaauccucuccauucgggauagggguauugguaugaccaaggaggaucuuauuaauaaccuuggaaccauugcuaagucuggcacuucagcuuuuguggaaaagaugcag

SEQ ID NO: 6790 - RNA, 189 nt, Zea mays
gggaggagggagcacccuucaguccaagcaaagacggugcgagaucgaagcuuuuaccucccgcuucauucacucaucugcaaagcugguuuccauggccguuugcuuggcaugugggugaaugagucggcagcuaauucgacccuagcaccgccccugaguggacugaaggacgcucucuuccaccca

SEQ ID NO: 6791 - RNA, 64 nt, Zea mays
guauacaggaguagguguuugcgaggaauucagaauuccucguuugcauucuacaguuucguuu

SEQ ID NO: 6792 - RNA, 181 nt, Zea mays
gccgaccuccgcgccgcgcaccucgcccgcacccacgcccgggccugaacggccccgccucccucaccccgcuccgccucgccucgccucgccucgugucgcaugacauacaauaccguaccugagugaaggcgaagagagaggccggugggggccgggguucgucuggcgaauggcgucg

SEQ ID NO: 6793 - RNA, 142 nt, Zea mays
  misc_feature (86)..(86): n is a, c, g, or u
  misc_feature (107)..(107): n is a, c, g, or u
uuccccgggcucggcacgcggucgggguggucgucucggucgaaggugaugggcuugccggaccagucuagauauacuggcgccgncaccuuuaccgagcagaccunccagcgcucuugcuugcggugccgagccgaggcgu

SEQ ID NO: 6794 - RNA, 103 nt, Zea mays
guucuccgggguucgguuucgugggugagcggaucgagauggcggcgucggauguugaguaccgccgcuucgucggcggccucgccugggccacggacgacca

SEQ ID NO: 6795 - RNA, 62 nt, Zea mays
uuggguuugacccgaaaucaucuacugcgauaucaaaguguaugauuaugggagcaucuguu

SEQ ID NO: 6796 - RNA, 62 nt, Zea mays
cguuggaucagaagccgggagcgccgccggagccgucgccgcugcccgcuuccgccgcggag

SEQ ID NO: 6797 - RNA, 131 nt, Zea mays
cacauggcagccauacaacgcaccugaguaugcugggaugaucuuuaguguaguaugcagcagugaagaugaacucuauaugaugcaauguccuuugucuguuucugguguguugaguggcaccuaccuca

SEQ ID NO: 6798 - RNA, 86 nt, Zea mays
guauuugauccagugucccagcgcgugcgagucagccgugaugugguauuugaugaaggacguggcugggacugggcaucagcggc

SEQ ID NO: 6799 - RNA, 141 nt, Zea mays
auccgaugcaacaucuacuuguucaccuaccauacgaagcuaagguaggagguccugugcaauauagauggauguaucacaaucgaaaggacacuaaagaagcuacgugcaaugguugguaauaagagaugaguugaaggg

SEQ ID NO: 6800 - RNA, 70 nt, Zea mays
aagaguguuaggaaggugugaagaucauggaaaacauuucccuguuucucaagacuuucccuggaccaag

SEQ ID NO: 6801 - RNA, 82 nt, Zea mays
aauacaguugaucacacuuugucugauguuacugaggcuaaugcaauugaugauguuguuccuaguguggucucugauguca

SEQ ID NO: 6802 - RNA, 88 nt, Zea mays
acacuacuucgagucucauccggugacuguggugucauccuucccccugguggagaucauccagugccgagaggccucggguaggauu

SEQ ID NO: 6803 - RNA, 225 nt, Zea mays
  misc_feature (106)..(106): n is a, c, g, or u
gauagcuggaacucguaacgaacgguuuuaucggguaaagcgaaugauuagagguccuggaguugaaacaacuucaaccuauucucaaacuuuaaauagguaagancccgaggguugcucgaacuuuucuugaacccucggcgcgaacggagaguucuuagugggccauuuuugguaagcagaacuggcgaugcgggaugaaccgaacgucgaguuaaggugccg

SEQ ID NO: 6804 - RNA, 69 nt, Zea mays
cccgcaggagcuagcugugguccgagucccuacgaggggucaggacacacagcucgagcaacucagcga

SEQ ID NO: 6805 - RNA, 110 nt, Zea mays
gaaaaaucaugagucugaugcuaaaucuuuguggucaaagaaggaugaaauguauugcauuaaugauccugaugacugucaaaauggcaugguaucagaugauaugcuug

SEQ ID NO: 6806 - RNA, 85 nt, Zea mays
cccguguaccggcucgcgugcaggcucggcgcgccgucgaaccgcagcacggcggagagguuguacgugauggccgaggccgcgg

SEQ ID NO: 6807 - RNA, 171 nt, Zea mays
gagcaaggaagcggacgacgagcuggaccuggagaacuucgagaugaugccgaugcucgacgucgacgaccccagcuucggcuuuggcacgcugguggacaccgcgccagcgccguacggcucggccguguccguguccguguccgcggcaacgucgccgugcgccucguc

SEQ ID NO: 6808 - RNA, 201 nt, Zea mays
gggcgacugcgagugcgaggaggcgauugguaauggcacacacuuuuuuuuuauaaagauacggguagccaauuugacuuggccugccaguuccgcgcagcccccuccaaauccaucgauaaaacacacaauaauaaccagagagucaguuugcguggauugccaucgccccuuccuccaccucugcgcuccaccaccuaa

SEQ ID NO: 6809 - RNA, 281 nt, Zea mays
cccgucauacggguuguaggugacgucggacgucgccuugcccuugugggccauagcauaagccgagaagauggagcaaggguagccaccaugugaugccgacuucaaguauugaucuugaguuaaugacaugguuugggcguccugcuuggucaccuucuccccaaggacgaagccaugguaacugacgauggcaccugcuggcaccgcgaaacuaucgagggggcaugcuuccaauuuucuucgcucugcgccgccgucgccugcucccgucccgccac

SEQ ID NO: 6810 - RNA, 133 nt, Zea mays; identical to SEQ ID NO: 6776

SEQ ID NO: 6811 - RNA, 76 nt, Zea mays
guuguguuugggccugagacgcggcacgguggccugacauggccugacucguuagcuagccgggccuagacguguc

SEQ ID NO: 6812 - RNA, 208 nt, Zea mays
uuagggaguguuugaaugcacuagagcuaauaguuaguuagcuaaaaaauugcuagcugaauuagcuagcuaacaaacaaguagcuaauuauuagcuaauuuacuaaaaagagcuaauaauuaguugaacuaauuaacuagacugguuuggacguuuucaaacuaauuuuuagccggcuaaccaauuaagcuuuuagugcauuucaaa

SEQ ID NO: 6813 - RNA, 61 nt, Zea mays
ccaggcaaauacccgcuccucgucgauccggugauccgagagagccggguaaagaaggugc

SEQ ID NO: 6814 - RNA, 167 nt, Zea mays
acccguucgucuaaugaugccgucccaagaaccagauccaagaaaccaaaacaaaaaaacaaaacaaaaaaccaaaacaaacucggauuccgaacgcaaaagagacgaagcuacuugggugaggcgugcuugcgccgagguguggccagguauuguggcuuggaacu

SEQ ID NO: 6815 - RNA, 98 nt, Zea mays
ccuggcgacugacaaccgacgggaauaagcccuaaaccgacgggaauuacuuauucucgucgguuuaggguuuauucccgucgguuucuggccgacgg

SEQ ID NO: 6816 - RNA, 242 nt, Zea mays
ccccgcaccaaaacagggguagagccguauucaugcugcagauuggucuuugcaggauuucgagauacauacuuguacauaggggugauccaccccccgcaccaaaacaggggaugaacccuccccugcaccaaaacaggggcccuuuucuugacaugcuaccaccucguacugguugucuucguuucgguaguuuguuuugcagucaugcauagccaguuaccucucguuuuauuauuugc

SEQ ID NO: 6817 - RNA, 201 nt, Zea mays
gccgccaagaugcgccgcuacuccgcgcugcccaacggcggccgccaggagacgcuggccgaccgcgcgcaccgcuaccggggcaucgugcucgucauccucgccccgcucgcgcucgucucucucguccuccuccucaugccacgcucacccgcuggcaccaugggcagcgcccgggauagacagguacacacucccccg

SEQ ID NO: 6818 - RNA, 81 nt, Zea mays
aaaucuguucagcuuaccuuuguguuccuuguucugccaugccuucuacugggauaccuagggcaagcugcauuucuuaug

SEQ ID NO: 6819 - RNA, 71 nt, Zea mays
aaacucaugagccuguuccacuacagaucgguucucaaccaucuuguagucauacagcugcuccaugagau

SEQ ID NO: 6820 - RNA, 73 nt, Zea mays
uagcggcaacgugagggaggggucguugauguggccgaugcucacacgcgacaacuacuccgaguggacgaug

SEQ ID NO: 6821 - RNA, 229 nt, Zea mays
gcacuaagucucgccuguugauuaucugaaccgcuucaccaagcaugagucgccccgugucaaggugacgagugagguauccguaucccggaggcguaggagucccucggcucgaucggccucguugucugaggcuccucuagcuuaguuaaagagaccccuuggccgcucuucgacgagccgaggcuagggguagcgauaucagcaugaacagaggcggaguuggcuc

SEQ ID NO: 6822 - RNA, 62 nt, Zea mays
ggagguguaccacccgggcgcccucaaggcggcguucgcugaguucaucuccacccucaugu

SEQ ID NO: 6823 - RNA, 130 nt, Zea mays
caaggcagggccugccuucgcgugggcuggcgucccgcuucuuccuccggcaucuggggguggaaaccauccuccagcucugcggaggaggcguccuccagccaugcgggggaaggcgaacugcugcugc

SEQ ID NO: 6824 - RNA, 100 nt, Zea mays
cggugcuaggaccuggcacaucuugcgcguccacggcauguggcgaggccuccgccgcagccacguccaaggccgcaaaauaguccaaguccuccuccuc

SEQ ID NO: 6825 - RNA, 119 nt, Zea mays
gcccggacuucgcugccuggagugggugcaggaggaguugcaggcgcuccccaccaucguggagggguuuaugucuuaugcuucccuggucaccugcgagggggcgaugaacgcgcucu

SEQ ID NO: 6826 - RNA, 70 nt, Zea mays
ugucuuuccugugucgagucggacgauccgcgccuggggccggacaguccgcgcgugcgcaugggcgacg

SEQ ID NO: 6827 - RNA, 73 nt, Zea mays
auuuuauaaagcgcagugaacagcacgccgucgacacucgucgguuguuugcuguuuuugcgcagccccaaca

SEQ ID NO: 6828 - RNA, 201 nt, Zea mays; identical to SEQ ID NO: 6808

SEQ ID NO: 6829 - RNA, 174 nt, Zea mays
aaaccgguggcuacggcuggggaagguucuucacgggaggcugcaccggccaugaagaagagaaaauuagguacuguagcugaaggguucggggucuccgaccauuuugcuguggaguuaauggguacuugcgcggcccucggggaaggaugucuucgcccgagcuccgggagu

SEQ ID NO: 6830 - RNA, 127 nt, Zea mays; identical to SEQ ID NO: 6725

SEQ ID NO: 6831 - RNA, 125 nt, Zea mays
aauguaccagaagauugugcugcauuaacagggaaguuacaaccuuuugucaaagaagaaguuuuggucccuguauucaauggaacuuuucccuguacugcagaacaguucuucaguauucuuuu

SEQ ID NO: 6832 - RNA, 85 nt, Zea mays
uuucagcuaucuuggagaaggcggguugcaaucacguuaaaaccuuagcccaggccgaagcugccuucuccguggaugacacaaa

SEQ ID NO: 6833 - RNA, 97 nt, Zea mays
uggcgguccugcaagggauuccugggaaggcccucgggaggauuuugcugugauggcgguccugcaagggauuccuggggaggcccucgggaggauu

SEQ ID NO: 6834 - RNA, 66 nt, Zea mays
ggcggcaccggccccggucgcucccgugccggagacggcgcuggacgaggaggccagggccgcggc

SEQ ID NO: 6835 - RNA, 90 nt, Zea mays
auguacucccuccguuucuuuuuauuugucgcuggauaguucaauuuuguacuauuuagcgacaaauaaaacgaaacggagggaguaaua

SEQ ID NO: 6836 - RNA, 121 nt, Zea mays
agcgcugggugcugcaagccgaccaccggcgucucgccggcgcgcgacuucuacauaacgggcuucaccguccuuaacgcgaccaccgacgcugcagugacgggaugcagcaacaaaguuc

SEQ ID NO: 6837 - RNA, 75 nt, Zea mays
cucccaacugaugagacucuuguggcccagaucaaggaaggguuugaaaguggcaaggaucuuguugugacuguc

SEQ ID NO: 6838 - RNA, 195 nt, Zea mays
aagacaguuguaggcagcucuccucuggcaggcaggcgcgcggucaucgucgccaucgacgacgguugcuuggcucugcuaugcuguguucguucguccauggugugcuagcuagccgugcaugcguugcaguguaacaugcgugcaugcacgcgcguacguccugccaaaggagaguugcccugcgacugucuu

SEQ ID NO: 6839 - RNA, 254 nt, Zea mays
ucagguuggaugacugggugcugugccggcuguacaacaagaagaacgagugggagaagaugcggcuggggaaggagggcgccgccaaagaggaggccauggacaugagcaccucccacucguggggcgagacgcgcacgccggagucggagaucguggacaacgacccgccguucccggauccgccggcgccggcgaugauggugcccaagaaggagcggguggacgccggcggcagcgccaggagcagcgac

SEQ ID NO: 6840 - RNA, 204 nt, Zea mays
ccucauccgggacaagcggcauccggacgguguggccgcggggcucgagcugcugaauucgaucugcgcggugcacaggccagcgagguguaugguuguuagcaucggugcggugccgcagcugguggaauuguugccggagcuagcgacggagugugucgagccggcuuuggacaucuuggaugcccugucugcgguuccaga

SEQ ID NO: 6841 - RNA, 94 nt, Zea mays
ucaaaacuaugcuuggugucugagugauguacguggaacuauggaucagcucuugugugcacuugcugaaccagauacccagcaguaagcuuuu

SEQ ID NO: 6842 - RNA, 62 nt, Zea mays
gugagggcuuguucguuuagaccaauccagagggggauuggucuaagcgaacaugcccugag

SEQ ID NO: 6843 - RNA, 153 nt, Zea mays
ggaagaugggcugccugguugcucugacgcugguauugauuuccucccugcugguuauucugacgguacugcugcugcuacugaggaaacugccucugguacugcugcugcugguucugacgcuggugcugaugcugggcgagaaacuccucc

SEQ ID NO: 6844 - RNA, 100 nt, Zea mays
aacggaucacaugcgcguguucuugguguugguacagucauucugaaguuuacuucgggaaagacggugcuauugaagaacgugcagcauguccccucca

SEQ ID NO: 6845 - RNA, 169 nt, Zea mays
ccuugaugaguccaccagggcgcuugcucaggcggccgagcagagggaggcugaccacgcggccauguccgaggccaucucggcuuucugccgagucuuuggcuucggugacguccccucgggaagcuccccucaaagucgccugcaggccuugggugaccaugugcgc

SEQ ID NO: 6846 - RNA, 145 nt, Zea mays
cguggagaaggcaagccgcucaacgcucgucgaugugcggagcuaugcacaaaucggaaucgccauaguccuuacaaacaucgauuggguuuguuuauggaccgagagaugaugaucgagcaacugauguggugccaaccacaag

SEQ ID NO: 6847 - RNA, 336 nt, Zea mays
gaaaagaauaucauugcaggagcagacuugagugauuuagccguggagcauucuuuuuguccaucuaaagaaaaugguggucaagacggugcuaaccuucucuugauuugcaacucauggcucacgagugucaauagccugcucuuggcuaacgagaaggccagugcuguugaugauauuggcuacggucuugacaaaagggcaccaguucaguauuacucacacaaucuuugcucauuucacaccaggucaucuucucagauugggagacauagcuucuaaagguacccaaccaacaucucaaggccgcugaguuucuccuguaaggccagcauc

SEQ ID NO: 6848 - RNA, 96 nt, Zea mays
gccauuucgacccgcgcggccggauccuuggaugguuccgaucgauccgggaccaagagacccaaggcuucgucaccucacccgggccccggcgcc

SEQ ID NO: 6849 - RNA, 65 nt, Zea mays
gcuuggccaggucaucggcgagcgguaccaaccucggagccaagcugccgaggccgugggccggg

SEQ ID NO: 6850 - RNA, 79 nt, Zea mays
ccccauggaguggggucguucguaccugcggaggggggaaccggaguuccguugguaguggcaucuccacuaggucucg

SEQ ID NO: 6851 - RNA, 84 nt, Zea mays
agucgucguaggcagcgagcgucucuccucucccacgcaucgcgccaaggaagagagagagaucgccgcuccccuucucggcgu

SEQ ID NO: 6852 - RNA, 64 nt, Zea mays
ggaagcuauggcacuggggcuaucauggcagugccugcacaugauucucgcgaccaugaauuug

SEQ ID NO: 6853 - RNA, 143 nt, Zea mays
uaggcauguguuugguuuguagccacaauugugguaagauuuuucucgugcugcguaggucccacuugucaaugacuuguaaaagcaugucagauucccuuagucaugccacaguuguggcgcagaauuugagcgcuuaaccu

SEQ ID NO: 6854 - RNA, 64 nt, Zea mays
agcagaggaggaacaccagcugagacuacucuacacccgagugucacagugguggcccaugaau

SEQ ID NO: 6855 - RNA, 100 nt, Zea mays
accaugaucuccgcgcgcaccgccgcagcuucccccgcuucccuguggaagcagggaggacgaagcgagggcggcggcagcugcgacggaugucggacuu

SEQ ID NO: 6856 - RNA, 217 nt, Zea mays
aagccggacgguccacgggugcgcagaggcgguggcguucgccaacagcaccuggaucuaaccucccgaaagggaccccaucacgaagaagagaucauaggguuuaucuugggauuaacauaccacccaagacaccuuuagacgacgugaagccgaagagaggugaaaauaaagaugagaaggcuaaguuacugcuacuccgagggcauaaaaagug

SEQ ID NO: 6857 - RNA, 70 nt, Zea mays
auugcuagcuguacgugucugugugugcaucugcagcagggugcaggcaggggcccguacguacgugucu

SEQ ID NO: 6858 - RNA, 118 nt, Zea mays
gggcugagccggagcucuaccucccgcgcggguucgugggucacccccuccugcgguguucgagggagagggugcucgcuggcccugcgggcgggucggacuucgacaacgcggggcu

SEQ ID NO: 6859 - RNA, 151 nt, Zea mays
ucgcguucugggucaaggagcacgucggccgcgacgccguggcgaugcgggagcgcgccuacgccgaggcggccauggcgcggcugcucgccaacccgagcgucgaggugcucggcaacguggccgcgcgccgccugcccaucuucuccuu

SEQ ID NO: 6860 - RNA, 209 nt, Zea mays
caugguucauuuaagcugcugcuguaccuggguaucugcgucgucuggugcccucugguguaccucuauauggaugucgucgucuaauaaacaucugugguuugugugucaugaaucgugguuguggcuucguugguuuaauggaccuguuguguccucuauguuguacccaaaacucuucugcagcaguauggcuugaauccuuauga

SEQ ID NO: 6861 - RNA, 65 nt, Zea mays
cgcggcggccaucaugaaggcggcgccggagcaucgcggcggcgcuuaacaagaugaagaaggag

SEQ ID NO: 6862 - RNA, 463 nt, Zea mays
cuauaaacuguagcggguuuucggaagcuaguggaacuuuguaaaggccucguaguguugcccugccgcgcuuccuagguagagguguaugggauucgcgaccccuuggcagauggguagcaugacuuguggguaaaggguacaaccucugcagaguguaaaacugguauacuagccgagcucacggucaugagcagcucaggacucucugauguuuaaauuauggaacuuaaauucaauuuugucauuugcauugcauggguuuguuauuaauuuuguucuauuacuuuacuuaugguuugguauuuacuuacacuuaguaacugcuaauaaaauuuugaccaacuacuuaaaagcaaugcucagcuuuaaccccuaucauugauuagccuuacacaucacaugaacucacaccuuugugaguuuauguccacugguuccccacaacuuguugagcuaugau

SEQ ID NO: 6863 - RNA, 66 nt, Zea mays
aaaugcuaggcgagaaacauucuuguguguaguuaauacgucacucugauguuuuuguuguuguug

SEQ ID NO: 6864 - RNA, 110 nt, Zea mays
cggcccccaggggaaggaugucuucgcccgagcuccgggagucuucggcgcggaugugggagguuaccgggggucgauggcccaagcacguuccuaucccccaugcggcu

SEQ ID NO: 6865 - RNA, 147 nt, Zea mays
gggaguuuccggucaaagaucugggcgugcuucaccauuuccugggggucacugcugagccucgccccucaggacuccuccuucaccagcgacaguauacgcuugacauucuggagcgggcccagaugagugacugcaagcccugcu

SEQ ID NO: 6866 - RNA, 125 nt, Zea mays
gccaacgacuggcggagcgccugcuccugcuacugucccaauggaaggacucggagagcuaaaagccucugccugaaggccuaaaguuugacagagaguaugcaugcuuccguccagagcguuua

SEQ ID NO: 6867 - RNA, 68 nt, Zea mays
gacgagcaggcggaggcgccgcgccgcgccaaggaggccggcaacgacgccuaccgcaaguccuugcu

SEQ ID NO: 6868 - RNA, 79 nt, Zea mays
caaggacgcggugcuggacggcggcaucccguucaacaaggcguacgggaugacggcguucgaguaccacggcacggac

SEQ ID NO: 6869 - RNA, 146 nt, Zea mays
ugacagcuuaggccuuguucguuucuaucggauugguaggccggaacgauuccuauccggauugcuucucuaauuuauauaaacuuugauuagcuggaacgauuccgggugcaauccgacggaaacgaacaaggccuuacugauuu

SEQ ID NO: 6870 - RNA, 71 nt, Zea mays
cgcgccgagaagaagcucccgggcaucgucgacuacuucggcuggugcaccugggacgccuuuuaccagga

SEQ ID NO: 6871 - RNA, 117 nt, Zea mays
acgacaccacgucgcaccugcucaccugggccuccuuccugcugagcacgcacccggaguggcagcacaggcuacgggacgagguccggcgggagugcggcgacgacgaggucccca

SEQ ID NO: 6872 - RNA, 163 nt, Zea mays; identical to SEQ ID NO: 6692

SEQ ID NO: 6873 - RNA, 118 nt, Zea mays
uuaguccauccacuuuauucuauuuuaguucauaaauuguuaaauagggaaacuaaaauagaguuuuaguuucuauauuuaguaauuuagguacuaaaauggaauaaaaaggagggac

SEQ ID NO: 6874 - RNA, 68 nt, Zea mays
cauaagcgacgauuugcucagggaagcugcaaggaggaucgauggcuucucuggcagggagauugcaa

SEQ ID NO: 6875 - RNA, 272 nt, Zea mays
gaaaacugauggccacucucagugaaggcggcgaugaugaaaccccacugcaagucaaacuuaauggaguugcaacuauuauuggccagauuggauuauuuuuugcuguuauaacuuucaucguccugucgcaagggcuauucagcaagaaauaccaugagcagaugcuuuuaagcuggucaggagaugaugcauuggagcugcuggagcauuuugcuauugcaguuacuauuguuguuguugcuguucccgagggauugccauuagcaguc

SEQ ID NO: 6876 - RNA, 87 nt, Zea mays
ugagaagaggaggccaaggagacuagcagugauaauaggcacuguuguugguucuacaucuuugcuucuccuugccuuuuguggucu

SEQ ID NO: 6877 - RNA, 297 nt, Zea mays
cuucagcuaggcaggagggcacaggaaggaggagauggcgucaaagaggauucagaaggagcucaaggaucugcagaaggacccucccaccucgugcagugcagguccuguuggugaagacauguuccacuggcaggcaacaauaauggguccaucugauagcccauauucugguggaguuuuccuagucacaauccauuuuccuccugauuauccuuucaaaccaccaaagguacagcaaacgagcauuuagggaaugaccauuccuuuuuuuuugugcauuuuguccuuuguuug

SEQ ID NO: 6878 - RNA, 250 nt, Zea mays
ccgucgggcuuggucuggaacuugguguucuccuugaucccggucagccggcuggcgaauugcgcgcccuccuggacggcgacguuggggucgggcuuguucucggaggcgaucugcugccagccgucgucgaugaugaggaaccgcggcggcgcgccgcccuuggacaggcucugaaggccguguuugacgccgucggcggugacgucgguguagaaggcgucccaggugcaccagccgaaccagucga

SEQ ID NO: 6879 - RNA, 120 nt, Zea mays
ggguaaaaugugcaggccaguugaguugggaggacugggcauuuucagccuuaaagaacuugguugggcuuugagaaugagaugguuguggcugacuaaaguggaaccugauaaaccuug

SEQ ID NO: 6880 - RNA, 69 nt, Zea mays
ccaggacagggacugguacuggaaggcguaccugcccgaggacgccgaccgggaccauccggcgugcaa

SEQ ID NO: 6881 - RNA, 94 nt, Zea mays
ccuaggauacauaauucuguuacgucaugugcuccacucugccugugaauuccugauaauagcacaaacgcaacggaguucuguuauccuugcg

SEQ ID NO: 6882 - RNA, 72 nt, Zea mays
caugggcgggggccuccuagcagcagcacccgcccugaggucagugcugccgcuguucggccccccggagca

SEQ ID NO: 6883 - RNA, 208 nt, Zea mays
uuucauguauaagcauccuugccaacauuguucaguaaaggaacauuguacuuccaaaucugcacaaacuuguaacuguaaugguaugaauucucauguauucuuccaugcugcagcauaaucuguuucauuuugcguuacauuguguaaucuauuuguuuuuuuuuucauuagugacaugguugugaguuuugccuuguauuuugaa

SEQ ID NO: 6884 - RNA, 266 nt, Zea mays
aaauacuucgggccuuaccaagucacugacuguguuggccaaguggcuuaucaccucaagcuaccaccauccagucguauccauccgguuauucaugucucucagcucaaguuggguaaaggauacaaaggaccugaugcucuuccccuaccgacugauauucccgaguucaguauuccuaugcaggugcuucagucuugugguauuuccaaaggacaacaccugguccaacaagucuuggugaccugguccggccuucuagauga

SEQ ID NO: 6885 - RNA, 254 nt, Zea mays
gcggcgacaacgcgacugcaggaggcugugcauggguuccuggcgugacguccaguguggcagcggcuugccgucuucaggcuacgacacguggcuuccuggcgcggcgucaagcacagcaagcagcggcuugcccucuucagguugcggcacuuggcuuccugacguggcgucaagcacgacaagcggcaacacgguugcaggcuacgguccgccguucccuggugcagcgacuugcaucgguauugcgcguu

SEQ ID NO: 6886 - RNA, 114 nt, Zea mays
cuaguguuguuuguguguguguuugugggagugguguuuaggucauuguaauuauuaucauccuucuuuuaaugaaaugauacgcagcucuccugcguguucgagaaaaaaaaa

SEQ ID NO: 6887 - RNA, 80 nt, Zea mays
gcccggcggccgcggcggucgucgacgucgagagcggcagccuguacucgucgucgucguccgugguggaucggcaggac

SEQ ID NO: 6888 - RNA, 88 nt, Zea mays
cgucuaggaccaucugcacggggaggaagccgaggccguuggccacgccgagcaucaccuccuucaucuccgcgcggaacucgugccg

SEQ ID NO: 6889 - RNA, 62 nt, Zea mays
gaagacccugagcaucuguuuagugaagguugccuuuggugcaaucuaugcucagguaaaga

SEQ ID NO: 6890 - RNA, 71 nt, Zea mays
gagcucgugacggcgcugcgcucccugggccagaacguggacgaggcggaggcgcggcgcuuccuggagga

SEQ ID NO: 6891 - RNA, 64 nt, Zea mays
cgggcugcgccgugagucgcugccgcggcacgucgcgguggugauggacgggaacucgcggugg

SEQ ID NO: 6892 - RNA, 186 nt, Zea mays
cuagggagcagggagggcgcacggcuggagagagaugggggaaggagagaggagcggcgcggcuggagcagcaaugccgcggcagggaaggagcucgacgccggagcaagagaaggaggccgcaguccgaacgcuggcgagcagggagaggaagaagcuccggcaggcgugcucccgugggagaac

SEQ ID NO: 6893 - RNA, 130 nt, Zea mays
cgagccagagucugccuccgcgugggcuggcgacccgcuucuuccuccggcauucggggguggaaaccauccuccagcucugcggaggaggcguccuccagccaugcgggggaaggcgaacugcugcugc

SEQ ID NO: 6894 - RNA, 233 nt, Zea mays
augguaggaggucuaguucugucccaggcgcagacgcaccaggccgccacgccaagaaccgccgcaccggcgccggcgccggcucaggcguuggagaagaggccgagggaccaggcgcagccaugcggcacaguggcggcggcugcggccgucucggucucggcgccgaguuuggacgaggucaggaaggugcacgcgcggcacaucaagcugggccucgaccggugcccgcg

SEQ ID NO: 6895 - RNA, 214 nt, Zea mays
cguucggccccgcgggccggauccgucgccacagauccgcugccuccuccccgaguccugccugaucggguuuuuucaguuuuccccguuccccgugggccacucgaucggccgacagggcggaaaggcugccccggccgacagggcugguggcagugaauccgcgcuggcaaauugaauuccggcggcgaaucccauccugugguccucucuc

SEQ ID NO: 6896 - RNA, 76 nt, Zea mays
gugccgaaaucgcugggcaacagcugugccaccguucaugagcagaggccuguuguugcuagggugauugacguuu

SEQ ID NO: 6897 - RNA, 112 nt, Zea mays
uuuaaaguaugaggugugauaggagagcugcuggagauaaacgguuuccuggagguaggcaaaugugucguucaacugcagcaucccuggcauaccuucaggacgugauguc

SEQ ID NO: 6898 - RNA, 77 nt, Zea mays
aacgggcgcuuggucgccucgaggccgugcccgauuucgacgagcugcggcagcgacgagcgcaccaggcugccgaa

SEQ ID NO: 6899 - RNA, 114 nt, Zea mays
ccaacauuugcccuccgagggaccaguuugacuaagucaucuggugccgaagacgccgcuagauggggaagacacugcccucgcucgaaguggucccguggggguuuuugaaau

SEQ ID NO: 6900 - RNA, 292 nt, Zea mays
agggaaauuuugacacaucauggugcuugugcuggaguauauuuuccugaucugagcuugccuuccucugacuuggaugguaaaaccaacuuugacucccuuaaaagggaacaugguaucgaucuaaacgaagauguccauuuggaacaccuugaaccagcauuaaagaagcauaagaaagagccaaaaugugcugaaaguaugauggauuaugauaaggaguugguugacagugauuaucuaaaaacggaaggagaucugagcaaugugccugauguauuaacugccgaac

SEQ ID NO: 6901 - RNA, 82 nt, Zea mays
gcuggauuuguuacacacaaaagccagagcaagcgaagcgaccacccaaagcgcuugcuuagcauuuggggauggguuugcc

SEQ ID NO: 6902 - RNA, 169 nt, Zea mays
ccuugauaaguccaccaaggcgcuugcucaggcggccgagcagagggaggccgaccacgcgaccauguccgaggccaucucggcuuucugccgggucuuuggcuucgacgacguucucucggaaagcucuccucaaagucgccugcaggccuugggugaccaugcgcgu

SEQ ID NO: 6903 - RNA, 250 nt, Zea mays
uuguuccaguuggauccaucaacaugagcgagaucaugacuggcaaguguaucgccaagauuacugccaacgauccugcccuaagugcgcccccucgcagaaauggucgcagcaagcggcgguccucggucuggagcaccguuccagaagcucuggaggacgucacggcacuguucuaugacgaggacaggaaugagaucuacaccggcaacagucauggacuggugcauguauggucuaacuagauggu

SEQ ID NO: 6904 - RNA, 67 nt, Zea mays
gguguucguagggaacugcuacgcugugcgcccugagcguguggugcugcgguuccccaauauaaag

SEQ ID NO: 6905 - RNA, 110 nt, Zea mays
uggcccccgggggaaggaugucuucgcccgagcuccgggagucuucggcgcggauguuggagguuaccgggggucgauggcccaaaaacguuccuaucccccgcgcggcu

SEQ ID NO: 6906 - RNA, 78 nt, Zea mays
gugcucaucaacaucguaccaucugcaugcgguuuuguccuacguaauugauaucacagcccauuggauggacuuguu

SEQ ID NO: 6907 - RNA, 205 nt, Zea mays
ccaugauccgcaccaagggggaggccggcacgggcaacgucgucgaggccgugcgccacgugcgcuccgucaugggcgacguccgcgcgcuccgcagcauggacgacgacgaggucuucgccuacgccaagcgcaucgccgcgcccuacgaccucgucaugcagaccaagcagcugggccgccuccccgucgugcaguucgccgc

SEQ ID NO: 6908 - RNA, 70 nt, Zea mays
aaauauaaguagcagcugcagcagguaggagcugcacacacccauccaauuccagcugcugaucuugauc

SEQ ID NO: 6909 - RNA, 124 nt, Zea mays
gccccaaagcgcaccggcagguccucacucccgucgucgccgcaagaacgagaaugggaccgucccagaacacgaguaccgcccucguggcguaugacguguugugcgaacccccggugcaggg

SEQ ID NO: 6910 - RNA, 267 nt, Zea mays
agacggaguggcuucuaggccgccuggggcaucucgaugauauggaaaaaaaacgucaucugggccuuucggccuguuagucuccguugggccaaaaacaaagccugaauacuggaccaucaucacggugcacggcguguuguuguggauccacaugcugaugaacacggucgugccgcagacgccgaggagcagcagguuuguucggacgcgcgagcgcggcgcacguacguugagggcaaggcggcgguggaugcuguaccugua

SEQ ID NO: 6911 - RNA, 59 nt, Zea mays
agcuggcccgcggugccugcagugcagcacugcacugcacgccuccgccauacugcgac

SEQ ID NO: 6912 - RNA, 165 nt, Zea mays
uuugaucggagacagggacgaggcagagcauggguagggggccaucaacagaauuccaaauuugauuucuguuugcucgcucacaaaauggagggacucaccacaaacacacucaggcguuguugcucccuccccugcacugccucuucccuggcuccucaccgu

SEQ ID NO: 6913 - RNA, 171 nt, Zea mays
cgccggcaaacagcuggaggauggccgcacccuagcagacuacaacauccaaaagggagagcacccuccaccuugugcuccgucuccgugguggucaguaagucaugggucguuuaagcugccgaugugccugcgucgucugggugcccucucuccauauggagguuguca

SEQ ID NO: 6914 - RNA, 213 nt, Zea mays
ugagcuggaaggagaggauggacgacuggaaguccaagcagggcauccucggcggcggcggcggcgaucccgaagacauggacgccgacgugccgcugaacgacgaggcgaggcagccgcugucgcgcaaggugucgaucgcgucgagcaaggugaacccguaccggauggucaucguggugcgucucgucguccucgccuucuuccuccgcu

SEQ ID NO: 6915 - RNA, 69 nt, Zea mays
ucuucaacuuugguacucagaaggaugucuccaacuggggcuuguucuucuguguugcaauugguccgu

SEQ ID NO: 6916 - RNA, 63 nt, Zea mays; identical to SEQ ID NO: 6768

SEQ ID NO: 6917 - RNA, 80 nt, Zea mays
gguaccuugugacgaccacggagauauagagaguuuguauuguauucuucaucuguguugggcuuugguuagcuaaguca

SEQ ID NO: 6918 - RNA, 62 nt, Zea mays
gccgcgccauggucccgcucggccucggcgccgacggcgccgaggcggcgggcaggaagggg

SEQ ID NO: 6919 - RNA, 81 nt, Zea mays
cgucgucgauguuggggcugcgcagauccggcgaagugagacacguagauggucgaacugcgcagaucaacgacacgacau

SEQ ID NO: 6920 - RNA, 76 nt, Zea mays
ugaccugcauuucccuagcaaguaugcgcagucuuccauuacacaaugcguggcuugccuauggaagcagaaccug

SEQ ID NO: 6921 - RNA, 320 nt, Zea mays
gagacuccaggacugaggcaucauccugcuguuauuaacaagauugcuagggugacaauucuuccaaagaguggauauaagagcaagaucagagauaaguucuggaacaucauccaccauaucaugaauggugaggcuaagaccagauuugaggggcguugugagauagcucacacucccuuuaagccuuucaagaaugagauuggauuccucaccaggccucuuacuccuuucccagaugaugaggaagaagcuggcgaugaugaaggaguugcuccugaagcugaugcagcugagcagaugucuccuccuccaccucc

SEQ ID NO: 6922 - RNA, 350 nt, Zea mays
cugugaccagcagggugagcucgccggcaacuggagguugcuucuccggcgaggucugacaaccacuacacgggcgaucgagggcggggcgacaucaacugcaggcgcaccgcgcgcggcggcuaccaggccuucagcggcgaguccguugaggucauggccaucuccgugcgccgcggccaggcgcgcgucugcaacgacauccagaccuggugcuucaaccccaccuagcucacgguucauuggcaaaguacaacagccugugggggaucgaccucuccgacucguaguuccggaucuccgacgaggccaaccucuucgucgucgugggcugcaacucgcuggcguau

SEQ ID NO: 6923 - RNA, 114 nt, Zea mays
gggguagagcgcggucgaccgucggccaugucgaggugcuuccccuacccgccaccgggguacgugcggaacccaguggccguggccgagccggagucgaccgcuaagguuugu

SEQ ID NO: 6924 - RNA, 69 nt, Zea mays
ccugcaugagcuagcuguggucccagucccugcggggggucaggacacacagcucgagcaaauucguga

SEQ ID NO: 6925 - RNA, 88 nt, Zea mays
acacuacuuugagucucauccggugacuguggugucauccuucccccugggggagaucauccagugccgagaggccucggguaggauu

SEQ ID NO: 6926 - RNA, 136 nt, Zea mays
uugcuucugaguggaauguugucugguucaaggucuugcuuuccgauuugaggaugauccaugcuugcauguguaguuuuuuuuguuccucagaucuacaagaucucggaccaggcuucauuccccucaggaauag

SEQ ID NO: 6927 - RNA, 145 nt, Zea mays
uuucuagcagacuccguauuuacacuccgcaugcagucuaugacagcuggggcccgcgagcaggagguggcgcaugcagucuucugcagagaggagagagaaaucguggaaaaagggagugcagguacacggugucuguuuugcg

SEQ ID NO: 6928 - RNA, 74 nt, Zea mays
cugcgcucccgggcugcagcuccuguguuugcguggcugcgcucccgggcugcagcucccguguuugugucgcc

SEQ ID NO: 6929 - RNA, 94 nt, Zea mays
uaauccacauguauugggugggauugagccgguuuaaauccauaacaagucaaaauccaccccaaucccacccaauacacuccaauacacaugu

SEQ ID NO: 6930 - RNA, 234 nt, Zea mays
uuuugcuauugcguuuaguaucuuccucagcuucagccuugcugccauguaugguguugcuguggcugcucuuggaaugcugagcaccauugccacaggucuugcuauugaugcauauggcccuaucagugauaaugcuggaggaauagcugaaauggcugggaugagccauaggauucgugagagaaugaugcucuagaugcugcaggaaauaccacggcugcaaugggaagg

SEQ ID NO: 6931 - RNA, 73 nt, Zea mays
ccgaagcaagcugcguuuuucguugggagggcaccucgucuuccuccugcggaugacaguaguaauacugaau

SEQ ID NO: 6932 - RNA, 87 nt, Zea mays
gugcucacagcagaucuccuucuggguccaggucucgauccccacaugauugggcaccuaggaacagaggcaagaucauggcaaaug

SEQ ID NO: 6933 - RNA, 76 nt, Zea mays
agaaugggauucggaugauagcucggaugaugaugaugacgacaccucauccaagcuuaaugccggaauugccauc

SEQ ID NO: 6934 - RNA, 72 nt, Zea mays
aacucaaaaugaggaugaagcucaaguugaugaaggagaagaucaagcaaaugagccaccucaagaugacgg

SEQ ID NO: 6935 - RNA, 262 nt, Zea mays
ucgacaagcucaaggcugagcgugagagagguaucaccauugauauugcucuguggaaguuugagaccaccaaguauuacugcaccgucauugaugccccuggacaccgugacuucaucaagaacaugaucacugguaccucccaggcugacugugcuguccuuaucauugacuccaccacuggugguuuugaggcugguaucuccaaggauggccagacccgugagcaugcucuccuugcguucacucuuggagugaaaca

SEQ ID NO: 6936 - RNA, 199 nt, Zea mays
ucggcagcuucgcguccucguccucgucgcgccgcgccucggacgccgaccaggaccugcgggagcucguccgcgccgcgucccagcgccgcgccgccgagcuggagcgccagcgccacccggccgccgugccgcgcagccgcagcgucgccgccgccauggcgcgcaucgacgaggacgggcccugcgacuucgccuc

SEQ ID NO: 6937 - RNA, 69 nt, Zea mays
cuccgcgccccggccgccgaggaggacugccgcagcuacugcggcuccuccucgucggcgcucugcgag

SEQ ID NO: 6938 - RNA, 174 nt, Zea mays
gcggccgcgcggucgcacuuccucucgcagccggcgccgccguggcugaucggcgccgacgccguggcgcgggccgcggcggacgcgcuagugccgugcgccgcaagggcgggcgaguccgcugcagacggcggagaagcgggcgccucgaggaggaagcggccgcgcgugguc

SEQ ID NO: 6939 - RNA, 70 nt, Zea mays
uguacccggccgccccgcugcuccugccgcacgagucgucggcggacugcaaggucggcggcuacgacgu

SEQ ID NO: 6940 - RNA, 71 nt, Zea mays
cccuuguuguuauaaaacuuuuaucacuuauauguugcauuaggugauaggaguugugugaauaaacaguu

SEQ ID NO: 6941 - RNA, 221 nt, Zea mays
uuaaugccgcuggcaguauucaucuuccuagucuauaaauacuggaaaaacaagauaacaguagaugcagucgagaaguucuugcaaaugcagcagaugcucguuccaaugagauaugcauacacaaacaucauugcuaucaccggccauuucagagacaagcucggacaaggugguuacgguucuguauacaagggggugcuacagccaggugaaguuca

SEQ ID NO: 6942 - RNA, 72 nt, Zea mays
agcucccaugccucaggauaacgaggguuacauuuuauacccugccggcuauccugagagcaaaauuaggaa

SEQ ID NO: 6943 - RNA, 116 nt, Zea mays
ggaaccgucgucucugccauuguccuucccgauguccggcggcggaggcaugguaacuugcucuucuguugacucgucgcucacacgggcgcgcgauggauugggacgaggugacg

SEQ ID NO: 6944 - RNA, 270 nt, Zea mays
ccaaaaggaagucuuggaugcuugguuugcucaugaggauuguguucuccuagcagccauaggaucaggagguaccaaaggaaaugagcaaaacauagcauacagucucagaugcugcaggugcacaucauguccauuuuuuuaaucauucaaguaaugccauuugccaauugguucuaacuucuuucauucuguaacuguuuaguuugaugcaaauaaauugcaaugguguucgucagagccaaacauagcagacaacacugcuuuagu

SEQ ID NO: 6945 - RNA, 68 nt, Zea mays
cauaagcgaugauuugcucagggaagcugcaaggaagaucgacgguuucucuggcagggagauugcga

SEQ ID NO: 6946 - RNA, 77 nt, Zea mays
ucgugaucugagggcguggggaucgugcugcgcaucgcgggagauggagggacgaauccugcgaucuggaucgcaga

SEQ ID NO: 6947 - RNA, 86 nt, Zea mays; identical to SEQ ID NO: 6713

SEQ ID NO: 6948 - RNA, 263 nt, Zea mays
caauacugguguacugugagccaagcgaugugguuguacucuggcagaaacacaaagauucuauguccgaggacuaccaacacaggagucagaacaaaacucauguugagcagaugguauugauugacauuaggaacaugcugcaaucaaugggaaaggacauaaauacauucccucuaccuccuaucaucgacgcguaugacgaugcuauugguacugcuagggagggcaagauugcaguggcaacagcuacaucugguguu

SEQ ID NO: 6949 - RNA, 122 nt, Zea mays
gguuauuuucaauccauauggauuggaggggauugauacggauuggaggggauuuugacuuaccagugauuuaaacccccucaauccuccucaauccauauggauugggguagaaccgaaca

SEQ ID NO: 6950 - RNA, 72 nt, Zea mays
gaaaccuuuugcacaauugauggcaccaaacaauaauggcaaugggccaucugaugugcaugcugagggguc

SEQ ID NO: 6951 - RNA, 79 nt, Zea mays
cugaacagauugcgggcgaggauuauguaaaugaaggggauucuagcauccuacgguuccuacuugcaaauaugucacc

SEQ ID NO: 6952 - RNA, 175 nt, Zea mays
aaaccgguggcugcggcuggggaagguucuucacgggaggcugcgccagccaugaagaagagaaaauuagguacugcagcugaaggguuggggaucuccgaucguuuugcuguggaguuaauggguacuugcgcggcccucgagggaaggaugucuucgcccgagcuccgggagu

SEQ ID NO: 6953 - RNA, 75 nt, Zea mays
auccaccaccgaggggcggcguauccagggagaacucaagaaucuccuggaggaugccgcaguucgacgggccga

SEQ ID NO: 6954 - RNA, 153 nt, Zea mays
aagugucugcgacaccuucugcugccgaaguagaagaaauuuugaagguaaugacugaaucuuugccugucaagcuaaguccgcuggcacaggaacugacaaaguuuuuucagaaggacaaaaaaacuucggcagcagaaagucccgcgaagc

SEQ ID NO: 6955 - RNA, 62 nt, Zea mays
gucugguccuacauccgggccgucgagcgcuccgggcucgaaggcucggaugagucggagua

SEQ ID NO: 6956 - RNA, 99 nt, Zea mays
gaaggcgccgacuaccuccgaggagcuguuccgggaagccgaccucuacaucaucgccgacgagcgagcccaggaccucaucggaggagcgaaguccgc

SEQ ID NO: 6957 - RNA, 77 nt, Zea mays
ugucuacuccauuccagcugaacguauggaugacugugcuguuguaaagaucuaacguauggcuggacagguaaacu

SEQ ID NO: 6958 - RNA, 73 nt, Zea mays
ugagaauggcucaccggauugcucggucuacgcguggcugcgggcgaccgaaguccggcgagggcgaucuugg

SEQ ID NO: 6959 - RNA, 72 nt, Zea mays
gucggguugccgaggccaugagccgggcugauguccucgggggacagcuggcugaggcuucggggcggccgg

SEQ ID NO: 6960 - RNA, 91 nt, Zea mays; identical to SEQ ID NO: 6715

SEQ ID NO: 6961 - RNA, 238 nt, Zea mays
cgcacucgcuuccuccucgucgucaaccgccgccgcccccacgccuucuuccaacccuuugcacgagccgaggccucuccaccucucgcucaagcccgucuuaccccuccccaaaccgcaugcgcucuccugcuccgcgccgcacaucccccgcgccgccgcuggggacggaucgggcgucgggaauggaggcaaggauggaggcggcggcggggguggcgaggaugaagacgacugu

SEQ ID NO: 6962 - RNA, 100 nt, Zea mays
aaugggucgcgugcucauguucuugguguugguacggucauucugaaguuuacuuugggaaagacggugccauugaagagcgugcagcaugugcccucua

SEQ ID NO: 6963 - RNA, 142 nt, Zea mays
  misc_feature (38)..(39): n is a, c, g, or u
  misc_feature (133)..(133): n is a, c, g, or u
uaccuuccuuaggugucaaaugugaugcuguaccuggnnguuuaaaucuuaccuccaucuugguacaacgagaaggaguuuacuauggucagugcagugagauuuguggaacuaaucaugccuuuaugccuancgucguaga

SEQ ID NO: 6964 - RNA, 73 nt, Zea mays
caaagcacuuggcaaaugcacaaggguuggcaguaauaacugucaugcuuguuaccacuugcuuaaugucacu

SEQ ID NO: 6965 - RNA, 74 nt, Zea mays
gcauggcaguggcacaagcgcuuugggcaccuuaacuucgaggcccugaagcggcucagugccaagaugagacg

SEQ ID NO: 6966 - RNA, 184 nt, Zea mays
uuuaggaguguuugaaugcacuagagauaauaguuaguuagcuaaaaaauguuaguggaauuagcuagcuaacuauuaccuaauuugcuaaaaguaguugauagcuaaaauauuagcuagacuguuuagaugucucaauuuuagcagcuaacuauuaguucuaguguauucaaacauucccuua

SEQ ID NO: 6967 - RNA, 121 nt, Zea mays
augaaaaacggaccgcgauccuggcagcccacaaucacaugaguugggaucguggacuccacaaucacaugaguugggaucguggacuuuaugggcugcaggcuucguaggccuuucgcgc

SEQ ID NO: 6968 - RNA, 89 nt, Zea mays
cagcuaggcuagggcacgcgcggaucgcggagagggggaggcgggggcauccuaugcacuggaucugggcguggauguuggcguggauc

SEQ ID NO: 6969 - RNA, 103 nt, Zea mays
ggugaaauguguagagguuuucaaggaauucuaucaaacaagaacgaagcacaggaagcugacauggauuuauuccuugggaaccugcaacaucaaugcuaag

SEQ ID NO: 6970 - RNA, 145 nt, Zea mays
aguuaucgagccacgaguauuucguccaucccuagugguaggccggcaaggucggcugguggagaccucgagucgagucgaccaugguggcgcgcgggcagggcgggacagggcggaggaggaggccguggcucguugggagagc

SEQ ID NO: 6971 - RNA, 84 nt, Zea mays; identical to SEQ ID NO: 6851

SEQ ID NO: 6972 - RNA, 87 nt, Zea mays
caccuggucguggcgcgcccccgcgugcugagcugccucgacgcagugggaggccagcagcucgguggccgacgccauggcugucgc

SEQ ID NO: 6973 - RNA, 294 nt, Zea mays
cuugcgaguauuuggcauucucguuugugucauauuaauuuuggcucuaugucucggcuugcaaccaugaguuuaauuccgaauaucaccauagucaaagguucuaagugccauaguugugugcagucgaagcaaccucgaaagccucauaaggcugcugaggagagacaccuggcaccgcuagaacucauacauucugaucuuugugagaugaaugguguguugacaaagggugguaagagauacuucaugacauugauugaugaugcgucuagauuuugcuauguauacuug

SEQ ID NO: 6974 - RNA, 103 nt, Zea mays
ccagauccgcacgagggagaugcaucugcaggccgaguacggguucgcggcgcacuggagguacaaggagggcaccugcaggcacucguucgugcuccggaug

SEQ ID NO: 6975 - RNA, 143 nt, Zea mays
caaguacaugcuguuccagcucuacuucugcgcggcggggaacggcacguucaucgacugccccgcgccgcagcaguacaccugcuccaaggagauccucuuccaccccuucaagaaguggaugcucaagcagcagcucaacc

SEQ ID NO: 6976 - RNA, 165 nt, Zea mays
ucaacauggaccuguucaggaagugcauggagccuguugagaaaugccugagggaugccaagauggacaagagcagcguccaugauguuguccuuguugguggcuccacuaggauccccagggugcagcagcugcuccaggacuucuucaacggcaaggagcugu

SEQ ID NO: 6977 - RNA, 95 nt, Zea mays
gauagaugaccuauuguguuucgccagccaggaugauguuuuguuggaugauguguuggucgugguuggcacaaaauucaguaggaagggcucac

SEQ ID NO: 6978 - RNA, 129 nt, Zea mays
gcaaguggcggcagcaagcuagaggcagcaacugcauaccuugcaagaaaaaaucgguuuuguugacguaccgaugauuuucuugcaaguugugcaguuguugucucaagcuugcugccucccuuugcc

SEQ ID NO: 6979 - RNA, 86 nt, Zea mays
uacucucuccguuucuuuuuauuugucgcuggauaguguaaaauuacaguauccagcgacaaaaauaaaaagaaacagaugaagua

SEQ ID NO: 6980 - RNA, 136 nt, Zea mays
cacgucagcgacgcaggcaagggcggcggcccgcgggcuccgccaaggaacaagauggcgcucuacgagcaguucaccgugccguccaaccgcuucagcucccccgcggccuccgcccgcgccgcgggggccagcc

SEQ ID NO: 6981 - RNA, 100 nt, Zea mays
aaugggucgcgugcucauguucuugguguugguacggucauucugaaguuuacuucgggaaagacggugccauugaagagcgugcagcaugugcccucua

SEQ ID NO: 6982 - RNA, 88 nt, Zea mays
cgaaccccgaccccucaccucgucucacccugguacguacggugcgcguaugucauacgagacgaggcggagcagggugaagggagcc

SEQ ID NO: 6983 - RNA, 89 nt, Zea mays
cuucgccgagcgcggcaaugccgaugcucccugucaaggagaucccuagauacuaaggaguauucagcugugcugugcguuuugccccu

SEQ ID NO: 6984 - RNA, 192 nt, Zea mays
aguucgccaucggguccggcggaucaggcacgguguacagggcggagcuguccacuggcgagacgguugccgugaagaggauagcgcacauggacagcgacaugcugcuccacgacaagagcuucgcgcgggaggucaagauccugggccgcguccgucaccggcaccuggucaagcugcucggcuucguca

SEQ ID NO: 6985 - RNA, 76 nt, Zea mays
aucugaagaucauccugguaccuggaaucucaagucccaggucaagaacagguaccgcaagaugaggcgcauggag

SEQ ID NO: 6986 - RNA, 111 nt, Zea mays
ccggacaaaacugcgaggacauguugcgucgaauuugcgguucgcucgcguggacgaccugccgcugccggaggaagaagccgacgggcgguccaucgcagauagcaggga

SEQ ID NO: 6987 - RNA, 72 nt, Zea mays; identical to SEQ ID NO: 6950

SEQ ID NO: 6988 - RNA, 104 nt, Zea mays
caucuaagcaugucaugggcauauccagcucuuucaaagcuuacaucccacauacacauuaugaguuuguucaaauugcugauggcucaucccaacgaauccau

SEQ ID NO: 6989 - RNA, 152 nt, Zea mays
uuucggcagccgaugcgugcagcggcugaaggacgcgagguugaugcucuugacgaaguuauugcugggcaugcugacuucugcgcccuaguagcuucucgaggcacagcuaccgcuuuucugaaggcuggcuguacgcacggaaaaauugu

SEQ ID NO: 6990 - RNA, 219 nt, Zea mays
cuacuagagaggcuagcuaggugguccucgaacgacagauguuggcgguguucaucggacaggugguggaggugccgccggagcugguggcggaggacacccggacgccgcuguccaauacgaaugcguggcuagcugguggcgcgcuuccuguacuacuccgauccgggcgcugucucgcacuuuugucagaccaccgcuuacuggccuacuugcacg

SEQ ID NO: 6991 - RNA, 72 nt, Zea mays
ugaaaauugacccaaaccuguacccuaaugggguaaaaacccaucggguuucggguuucggguacccauugu

SEQ ID NO: 6992 - RNA, 159 nt, Zea mays
ucccgauggccucgcgccgccgcacccugcucaaggucaucauccucggcgauagugggguugggaagacuugggggggggggacuuucucaacaagaauuccaccaccacauacaaagcuaggggggggggggcuagcgcggcgcggggggggcggcg

SEQ ID NO: 6993 - RNA, 132 nt, Zea mays
uaaggucuuguucguuuccaccggauugauaggucggaauaauuccuaaucggauugcuucucuaauuuauauaaacuuuguuuagaugaaaugauuccggguguaauccgaugcaaacgaacagggccuaa

SEQ ID NO: 6994 - RNA, 61 nt, Zea mays
gcgcuacuuggccgacacggcagcggcucccgcugcugcuggugucgucccuggccucccc

SEQ ID NO: 6995 - RNA, 87 nt, Zea mays
gcacgcgcagccccgugggcuggcuccgcgacgccaucuccgccucggagccggacgucgucgccgccggcggggucgacgccgccg

SEQ ID NO: 6996 - RNA, 73 nt, Zea mays
aucaagcaugaguucucuucucccuacaugccacaacaaaaugguguaguggagaggaagaauagaacuauac

SEQ ID NO: 6997 - RNA, 62 nt, Zea mays
cucugcgccuucaugcccgacugcgcggcgcggccgucgcacgugcuggagaaguucgugga

SEQ ID NO: 6998 - RNA, 117 nt, Zea mays
ucuggaaagcaucagcauguucuucggccuguugagaagccacaugggaaugauggugucuugugugcaccaguuaagccaccagugccgaaugagcacucugauggagccaugccg

SEQ ID NO: 6999 - RNA, 59 nt, Zea mays
gcaugaauaaagauggaugcuggugacucugucgccaucgccguccaucaugagugucc

SEQ ID NO: 7000 - RNA, 76 nt, Zea mays
caaaguugcuuguaucggugcauggcauccggcuagggucuccuauacgguugcucgugcuggucagaauggguac

SEQ ID NO: 7001 - RNA, 141 nt, Zea mays
gcagcagcgguggaaggggcaugcagaggagcacgagcgagguguggcuggaagaagcagccggggccugugugcuauauacccccucgcaagcucuccucuccucuccucuccugugccugccucuuccauuccuucugc

SEQ ID NO: 7002 - RNA, 78 nt, Zea mays
ucgcgcgauucgagaacagccgcgccgagcagcgccgugagcuggcugcuacagcugcagcuuucucgaaguugacug

SEQ ID NO: 7003 - RNA, 101 nt, Zea mays
gccagauccccguggaucgcuccuauauggauugaaacccggucacaagaaaauauguguucgauuaauucacgugugggcugcaucccggacgaacccug

SEQ ID NO: 7004 - RNA, 73 nt, Zea mays
gggauccacaggggaggaauucccuugcaauucaauuuuuaauagcaagaggauuucuuccccucgggauccc

SEQ ID NO: 7005 - RNA, 96 nt, Zea mays
ggggaucgauauccugcccgucauccuccgacugggccguugcagagugggcaguugaucggcccguuagugaugggggccaggguucgggguuuu

SEQ ID NO: 7006 - RNA, 163 nt, Zea mays
caucagcuagcagcuagcgcgcuccucgagcccagcagagaaggccggagcgcuaaucguaauagcuggcuccaccgcgcacgggcggggggacaggagggcaugaccaugcgugcgugcgucucugcaugacgcugagacgcucacuggcugugagucugag

SEQ ID NO: 7007 - RNA, 205 nt, Zea mays
cuggcaacaacaccggggacggcggagugugcguaucagcggcuggacgguuguaauuuauagcgugaagcaugguuggucuacgugccuuguuuuuuccaucuucgaaucuugagcaaaugcaguacauguacagcucccucccucucgucucaaucuguuacauacauauacacacauaccguauccucuguggugguugguc

SEQ ID NO: 7008 - RNA, 281 nt, Zea mays
ugcugugcaucggcgacgaccggucggacgaggacauguucgagagcaucgugugcccggccuccagcagcggcggcgugaggcucccggccagcagcgagguguucgcgugcacggugggcaagaagccgagcauggccaaguacuaccuggacgacacgguggacguggucaagaugcuggacggccuggccagcgcgccgucgccgccacgacggcccgggccggcggcggcggugcagcuccgggucucguucgaaggcucgcucugagggggggaa

SEQ ID NO: 7009 - RNA, 71 nt, Zea mays
ucccucuccgccucccguccccaaggccaauaguuuucaaguggcaauggcggaccaggcuaaccaaccca

SEQ ID NO: 7010 - RNA, 93 nt, Zea mays
agaacgaacuucgcgccgcgggugcucagcuuaaggaucuggcugccgugucaucggcgauagguuccucagcccugcggcgcacacagauuu

SEQ ID NO: 7011 - RNA, 126 nt, Zea mays
aggagcagaacauggugcagcagacggugggcuucaacuggggcgccgccggcguguccacguccguguggcgcggcgcgcgccuccgcgacgugcuccgccgcugcggcaucgugccccgcaagg

SEQ ID NO: 7012 - RNA, 146 nt, Zea mays
augugcucaugugcagaugccacauggccggcucaaugauuucuguuugaucagcuacucucacuaaaucacccaauugcuuuagaacuguuaagaaaccaguuuggacccgaagcccauguggcccaucuagccgaaacccuaac

SEQ ID NO: 7013 - RNA, 114 nt, Zea mays
gcucgcugaagcagcagggugcgccaccguaggcugucuguaacugucgcuugcacccccuccagugcugaccagcuacacccugcgugccgcaccgaugcugucgucgacugg

SEQ ID NO: 7014 - RNA, 187 nt, Zea mays
ggaagaguacucgagggcuaacaaggaguuccgcaagcuggagagcaccauggaguugaucaaagaccugagaucgaaacaggaggaaauggagggucucaaaucuuugguagcaaaugaucaugaagagaaagacaugcgugagauggcagaagaggagcuucuuguggcugucgaggaggagaaa

SEQ ID NO: 7015 - RNA, 72 nt, Zea mays
aacucaaaaugaggaugaagcucaaguugaugaaguagaagaucaagcgaaugagccaccucaagaugacgg

SEQ ID NO: 7016 - RNA, 75 nt, Zea mays; identical to SEQ ID NO: 6756

SEQ ID NO: 7017 - RNA, 248 nt, Zea mays
ccgccgagccccgccgcagccgccgucgccaucugcuucugcuggugguguucaccugccaucaccugaugauauugccuaccggugcuggcacagcucggcuccgucuggccgcucaucaucgccaucgacaucgcguggagugcuggcggcgacgacggcauggccggcguggcgccgagguugagguugaggcggccgccgccagagagcgugaacgguggcgcagccacggcgggguucaugua

SEQ ID NO: 7018 - RNA, 98 nt, Zea mays
acuccgccacgcaccgcagcugcgccacguucgccgcgguuaucucgaaguuugugccguagcagaacuuggcggccagcucgaacgcguaggcuccc

SEQ ID NO: 7019 - RNA, 67 nt, Zea mays
gauagcuaugcgggaguucagggacuuguucgaggggauccaguccaugaccuacugcugcgguaac

SEQ ID NO: 7020 - RNA, 199 nt, Zea mays
uuccuuacucgcgcucggcacacaggcggcggcgcucgggcucucagcgacggcgucagcggcuuacccucgcgcccucgccuccgguccuccgcacaccggccggugacccugcgugcgugccuaucucucucaucccgcccccgguggaucgucaacgccaccggccccgccagcugcgccgcgcgcggccugaugg

SEQ ID NO: 7021 - RNA, 79 nt, Zea mays
cuagcuucauuaccacuauuggcauugacuucaagauaagaacuguugaguuggauggcaaaaggauuaaguugcagau

SEQ ID NO: 7022 - RNA, 272 nt, Zea mays
caguucgacaacguguggauacaguucuacaacaaccccgggugcgcguacgccaacggggacgacaccaaccuggugaacgcauggaacacguggaccagcagcaucaccgcggggagcuucuaccucggcgucccagcgucuccccaggccgcgggcagcggguacaucgaccccggcacccugacgggcacggugauccccgccauccgaggcauuggcaacuacggcggcaucauggugugggaccgcuuuaacgacgugcagaacaa

SEQ ID NO: 7023 - RNA, 66 nt, Zea mays
gauaacucauggcagccugcucguucgggaggacuucuggacccaaguaagcugccugauuuaugu

SEQ ID NO: 7024 - RNA, 73 nt, Zea mays
cgaguuccaggacggcgagcucgugcgccugcugcccaagugcgcgcacgcguuccacguccccugcaucgac

SEQ ID NO: 7025 - RNA, 355 nt, Zea mays
caagaagcggucauggccggugaugaggaggaccaccuagcagacgcgccgcggguggugggcguccucuccgcgcuccuggaacgugucguggagcgcaacgacgcgguggccgaugagcucgccgccgggaccgaguccgcggcgccgccgucggcguuccgggcgacggcgaggcccgacaucucggugcgcucguacauggcgcgcaucgcgcgguucgcagggugcagcccggcuugcuacgucguggcguacgucuaccucgaccgccuccugcgccgcgcccgcagcgcgcccgccguggacucguacaccgugcaccgccuccucaucaccgccgugcucgcggccg

SEQ ID NO: 7026 - RNA, 79 nt, Zea mays
cauccaauaagacaucauccuggcuguagaaucgaugaagaucaacuaucucacguauaggaagauguuuucacaguau

SEQ ID NO: 7027 - RNA, 69 nt, Zea mays
cugggaucuugcagcagcuugacuauggucugguugaaugccaggcccugguucuugcucccacccgug

SEQ ID NO: 7028 - RNA, 85 nt, Zea mays
ugagcaaugagcucggcgccggccaccccaaguccgcguauuucucgguguggguagugaccgcgcugucgacgcucauaucuau

SEQ ID NO: 7029 - RNA, 72 nt, Zea mays
cuguguucauccucggcuccagcagacccaugcaucaaccagcauggacugcggaucgauggaugcuguuac

SEQ ID NO: 7030 - RNA, 59 nt, Zea mays
ccucaaucuaugguguggcugcuggguauuguuuaucagcgucgcugcucucgaucauc

SEQ ID NO: 7031 - RNA, 180 nt, Zea mays
cgcacgacggccgcgccuucgccugacgaccuccuccggccuccucgucugccggauccuuccuuauuacuacucaccggcgccgcuucguccccguuggcggucgucgucuccggcggugcgauguagacgaagggcccgacgaggcagucgucgagcgcgaggagcggcucgagcgcu

SEQ ID NO: 7032 - RNA, 205 nt, Zea mays
agcuuccuguaccauaguagccaccuuucuuucuuggugaauuauuuguuguggagcuuuucacauuugauacaagaccacaagagacacgaagaugaccggggguaucacuagacuagcauccauggaguucagcaucauaucuucaucugcaacuucugaucaaaauuaagcaagggugagcucacuuauggucggggcucag

SEQ ID NO: 7033 - RNA, 131 nt, Zea mays
gcacaucaagguugugagagaaggucuggagccgcaggaguucugggaugcauuuucaaguaugccaccuaauucagauaguaauacaaagauuagcaaggaccagaucgauucagcauccaagagugacc

SEQ ID NO: 7034 - RNA, 111 nt, Zea mays
auggcggccuggaugagauucuaagcaaguugaacauugaagugucuccaacuuuacuccucacuggauuuggugcuuuuauugcuuuauggauccuaucuucuguuguug

SEQ ID NO: 7035 - RNA, 119 nt, Zea mays
acucucauagggguuugcuugcuuaugaacaugccacuuaccagggacacccuccuguacucgaaugucaagaucgauuaguuugaagggguguucgcggcagcuacucuugggguuca

SEQ ID NO: 7036 - RNA, 156 nt, Zea mays
gcccuccguggcggugcgggagacggcugccgagcaccuagaggagcgucagaccgacugggccuacucuaagcccgucaucguggucgacaugcucuggaacgucgccuucgucgcaaucgccgcggccgucgucgccgcgucgcugggcgagau

SEQ ID NO: 7037 - RNA, 127 nt, Zea mays
gagccgaucgugaucgcggcgaaccggcagcugagcgugcugcacccaauccacaggcuccucaagccgcacuuccggaagacgcuccacaucaacgccgucgcacgccagaucaucgucggcucgg

SEQ ID NO: 7038 - RNA, 186 nt, Zea mays
cgcgagccuuguacaccgugcugcggucgccgcauaucgauaagaaguccagggaacaguucucgaugcaugucaagaaacaguuuguggaacugacagccaaaccgcacgagcuccacaagaaguucuucuggcuaaaacgccugcgcauaccuggggcccaguacgaggugcagauuucuuuca

SEQ ID NO: 7039 - RNA, 257 nt, Zea mays
aagacuaucacccucgagguggagucgucugacaccauugacaacguuaaggccaagauccaggacaaggagggcauccccccagaccagcagcggcucaucuuugcuggcaaacagcuugaggacgggcgcacgcuugcugacuacaacauccagaaggagagcacccuccaccuugugcuccgucucaggggaggcaugcagaucuuugugaaaacccugaccggcaagacuaucacccucgagguggaguccuc

SEQ ID NO: 7040 - RNA, 78 nt, Zea mays
ccgacggcugggcccaaguuucacccgggggguucuucuucggcggcaucuccggcgugcucugggccuacuuucucc

SEQ ID NO: 7041 - RNA, 106 nt, Zea mays
uuuugaaaaacuccgauggugauguaauaaucuuaauacucuuacaugcaugguuuuaugcuuuauuguauuugcucugugacucaccaucgagugagauuguggu

SEQ ID NO: 7042 - RNA, 261 nt, Zea mays
uccgaauggggcgccaccaggcaggccgccgcgccauccucuucgaggagacgcuguaccaguccgccgucgacggccgcaagaucguggacauccuggcggagcagggcaucgugccggggaucaagguggacaagggccuugucccgcucgccggcuccaacaacgagucguggugccagggccuggacggccuggcgucccgcgaggccgccuacuaccagcagggcgcgcgguucgccaaguggcgcaccgucguca

SEQ ID NO: 7043 - RNA, 98 nt, Zea mays
cgucugggugaacugcuucgacgucuucgaugcugcgauuccguuuggcggguacaagaugagcggcauggggagggagaagggcguugacagccuga

SEQ ID NO: 7044 - RNA, 98 nt, Zea mays
ucuugaaauaugcaugagguacugcacuuagggggaguauucaaaacucaaaacacucaugaaaaccccuagugcaaaccaaaaugcaaauuucacca

SEQ ID NO: 7045 - RNA, 125 nt, Zea mays
auuucuucaggugcgaugcuggauacgaggccagggcggauguggugucuacgacgugcuguaagaagcucgucguggacaugcacuacgaggcgcgcauccaggccaucgucacuuaccacggc

SEQ ID NO: 7046 - RNA, 79 nt, Zea mays
ugcucacucgcgucgacgacugggcuaccggcgccuccacccuccgccugguguccuucgccgucgacgagcgcacacc

SEQ ID NO: 7047 - RNA, 70 nt, Zea mays
gcaugucgcugggucugccgguugccgcgacggugaacugcgcggacaacacgggcgccaagaaccucua

SEQ ID NO: 7048 - RNA, 229 nt, Zea mays
aguauucuuggccguguacuacuuguuccaugcucggcaaagagcucccaaaacaaagagugaagauucaagaugaagugguugcuaaagaggagucuacucaagugucuuaucaucaagaggauggagcuaucuaauugaugguuggguagagggaucuagaaccucuucacugcaaaaagguucuuuggaggacaugguugcuggagugacuuggccguccaucuug

SEQ ID NO: 7049 - RNA, 496 nt, Zea mays
uccgaauggggcgccaccaggcaggccgccgcgcccaggccgcccaccgucuccauggucguccgcgccuccgccuacgccgaugagcucgugaagaccgcgaaaacgaucgcgucgccggggcggggcauccuggcgauggacgagucgaacgccacgugcgggaagcggcuggcguccaucgggcuggagaacacggaggccaaccggcaggcguaccgcacgcugcuggucacggcgccgggccugggccaguacaucuccggcgccauccucuucgaggagacgcuguaccaguccgccgucgacggccgcaagaucguggacauccuggcggagcagggcaucgugccggggaucaagguggacaagggucuugucccgcucgcuggcuccaacaacgagucguggugccagggccuggacggccuggcgucccgcgaggccgccuacuaccagcagggcgcgcgguucgccaaguggcgcaccgucguca

SEQ ID NO: 7050 - RNA, 196 nt, Zea mays
agccuuacacgccugaagaaguugaucgccgagacaaacgaccuugaugagcugccauacacuaucggcaauugugugucacugguggaacugcggguaggauacaaccaccucaaggcccucccggaggccgucggaaagcuagagucucuggagguccucucugugcgauacaacacuauuaggggccuuccaa

SEQ ID NO: 7051 - RNA, 242 nt, Zea mays
cggcggcgcgggcggggagugcgugcacgugaagacggccacgcaggcgcugccgcggggcggcgacgugguguucggcguggcgcaccagcacgcgggcggcgccggcgcgucgcugcacggcgccgacggccgccugcugugcgaguccgcggccacguacgggggcgggcgggaggccggggacgaggcgggcuacaucgucggcauguccacgugcuacccgcgcccgggcgccguca

SEQ ID NO: 7052 - RNA, 69 nt, Zea mays
cggcaucggcgcgcagaccugcuccgacgggagcuccuacgucggggaguucaagugcggcgucaagca

SEQ ID NO: 7053 - RNA, 158 nt, Zea mays
caaagcucucuggcaucucugaaaucauccccgagauggagaucugcgauuuugacuuugaacccuguggcuacuccaugaaugcgauccauggcucugcauucucuacaauccaugugacgcccgaggacgguuucagcuaugccaguuacgagguu

SEQ ID NO: 7054 - RNA, 105 nt, Zea mays
cggggcaguggcgugccgaagcgcgugcgaggcguucgggacgccgcaguacugcugcagcggcgcuuaugggaaccccagcacgugccggccgucgacguacuc

SEQ ID NO: 7055 - RNA, 111 nt, Zea mays
cggcaaagccguugguccacccaaggcauaucaccucaguauggaagaacggaagucugcuuuacuguacauguucacgaauaugccugagguggagaaauacuuugucga

SEQ ID NO: 7056 - RNA, 90 nt, Zea mays
gagaacccauacuacgcaucgcggacgguccgguguccaggcgcggacgguccguaacaucaccggacgguccggagcguuccagcggac

SEQ ID NO: 7057 - RNA, 73 nt, Zea mays
aggcucccaugccucaggauaacgaggguuacauuuuguacccugccggcuauccugagagcaaaauuagaaa

SEQ ID NO: 7058 - RNA, 249 nt, Zea mays
gcuacacuguguagauaauuaugcaauucgguauacugcguaaaaaucugcuacaggcugcaugcacacgaauuuaugauggaaagaauaugcaaugaaaggaaaugaauugcaugcauagaaacaaaaaaucacauuuaauguuuuauuuccuucauaaauauaggaucccuccaacagccaugcagcuaaacgcauuagaacuaguuuaugauguauacugaaacaaauuauacuacacgguguagg

SEQ ID NO: 7059 - RNA, 75 nt, Zea mays
cacaagcacacacuagcacaaggaucguucgaucguucuucgaucguucguccccuguucuuaguuuguucguuc

SEQ ID NO: 7060 - RNA, 82 nt, Zea mays
ccacacaagcacacacuagcacaaggaucguucgaucguucuucgaucguugguccccuguucuuaguuuguucguucguuc

SEQ ID NO: 7061 - RNA, 76 nt, Zea mays
uagccucguaccugagauaacggugcaguccguccccgacgcgacuucgccaccguccaucgaucaagagguaucg

SEQ ID NO: 7062 - RNA, 95 nt, Zea mays
aagucacauuucaacauugugguuauuggccaugucgacucuggcaagucgaccaccacuggccaccugaucuacaagcuuggaggcauugacaa

SEQ ID NO: 7063 - RNA, 71 nt, Zea mays
gaguucagccuggcgcaucggacacuguccggugcaccaccggacaguccggugugccagacugagcugcc

SEQ ID NO: 7064 - RNA, 232 nt, Zea mays
aagcaagacggcuaaagcucaggagaaggaugcugaugcaaugcagguugacaaugccagugagaagaaagcuccuugaccagaagcaucguaucaacuccuguggagcacagcucgggugauacgugcacuggagaaguucaucaaguuucuugaaaacagccgauacgucccugugaaaccagcgccuucuggauucauccuccuccgagaccuucagcccacugaggcc

SEQ ID NO: 7065 - RNA, 72 nt, Zea mays
ccugucggguugagucgacgguccaucaggucaugugguccgagcugaaaggccgagacucgaagacaguuc

SEQ ID NO: 7066 - RNA, 72 nt, Zea mays
ccugucggguugagucgacgguccaucaggucaugugguccgagcugaaaggccgagacucgaagacaaauc

SEQ ID NO: 7067 - RNA, 72 nt, Zea mays; identical to SEQ ID NO: 7065

SEQ ID NO: 7068 - RNA, 101 nt, Zea mays; identical to SEQ ID NO: 1192

SEQ ID NO: 7069 - RNA, 68 nt, Zea mays
ugauggaggagaccugguguacauguacguguguaucuagaugcaugugcccagacugcaggaaacau

SEQ ID NO: 7070 - RNA, 90 nt, Zea mays
aaguacucccuccguuucuuuuuauuugucgcuagauaguguaaaauugcacuauucagcgacaaauaaaaagaaacggagggaguacuc

SEQ ID NO: 7071 - RNA, 65 nt, Zea mays
aaaaaaaaucagguguagcuuuuguaacugcaaaaugauugcagcagguauaccugaagucugag

SEQ ID NO: 7072 - RNA, 148 nt, Zea mays
gugcuugcaggugcagcaccaucaagauucacaucguccaacucaugcaucaugcauauaugcaucuucaaugaugcauggcucgcauguguguguauauauauauaugaugaaaugagaaucuugaugaugcugcaucagcagacac

SEQ ID NO: 7073 - RNA, 74 nt, Zea mays
auuccuuuuuaugucuaugacuaauguguuuucaaguccauuucaaaccaagucauagguguauugaaagggaa

SEQ ID NO: 7074 - RNA, 67 nt, Zea mays
agcuuaaaccugaugccagggguccagugcuguguuuuguuggaccaccugguguugggaagacauc

SEQ ID NO: 7075 - RNA, 86 nt, Zea mays
cuuccucguugccauugccacguccgucgcccccucauuccccauccugacgauggcggcggacgcggacaacggcaccacccacc

SEQ ID NO: 7076 - RNA, 80 nt, Zea mays
ucaccccgaugcucucaaggucguugacgauagauccagagucgcucgacgucgagacacuuggaguagagaaggccaca

SEQ ID NO: 7077 - RNA, 65 nt, Zea mays
ugccccaccucgauggccacgcugagccguacaugcggcagcuggccgucggcgacgugguggcc

SEQ ID NO: 7078 - RNA, 82 nt, Zea mays
aacgaacgaacaaacuaauaacagggggacgaacgaucgaagaacgaucgaacgauccuugugcuagugugugcuugugugg

SEQ ID NO: 7079 - RNA, 270 nt, Zea mays
caagaugugugagaucgcugaagauuaccuuggaaguacgaucaagaaugcugugugucacggauccugccuacuucaacgacucacagaugcacgucacgaaugaugcugccgugauugcuggccucaaugugcugcguaucaucaaugagccaaccggugcugcuauugccuaugaucuugacaacaaggcgaccagcgacuacgagaauaauguccucaucuuugaccuuguacgugguaccuucgaugucucccuccuuacuauug

SEQ ID NO: 7080 - RNA, 88 nt, Zea mays
acacuacuuugagucucauccggugacuguggugucauccuuaucccugggggagaucauccagugcugugaggccucggguaggaua

SEQ ID NO: 7081 - RNA, 71 nt, Zea mays
gcucuccuugcguucacucuuggugugaagcagaugaucugcugcugcaacaagauggaugccaccacucc

SEQ ID NO: 7082 - RNA, 82 nt, Zea mays
ccgcgaaucuggcgggcaagucgggcgugcgggucgucgugaucggcgaccccggcaccggcaaguccagccucaucgucgc

SEQ ID NO: 7083 - RNA, 99 nt, Zea mays
agggcaguaggggaguggucaguguagggaggcccucgggaggauuuugcugugauggcggucagggauuccugcauuggagcuuccuauaaacuguag

SEQ ID NO: 7084 - RNA, 65 nt, Zea mays
ggggaaaaucagguguagcuuuuguaacugcaaaaugauugcagcagguauaccugaagucugag

SEQ ID NO: 7085 - RNA, 87 nt, Zea mays
uuugcuugcuacgagacugguggaucaacacacgagagcacgcgagaguuuauagugguucgggccgccggagcguaauacccuacu

SEQ ID NO: 7086 - RNA, 99 nt, Zea mays
ggcugguguacacgguguacgcgacggcgguggacccgaagaagggcagccugggcaccaucgcccccaucgccaucggcuucaucgugggcgccaaca

SEQ ID NO: 7087 - RNA, 311 nt, Zea mays
aaccuucgaaccccugaucaguaggagggcucggggcucguuuccuucgcugggaaggguccuuuuucgaaauacccccuuucccgaucccuguggcaagagagagagagggaaagaaaaaggacaugaauuuaaauaaggcggcacaccuuuuuugacacggucauuaugacggagacgaaacggcgcccgcuucuucugccggagaugucgcuugcccugccaaggaguuaaugcgacgggacgguugaggcgccgccgcccguggucauccccgaccucuccguucucggccaggaggagggggcggc

SEQ ID NO: 7088 - RNA, 118 nt, Zea mays
cgaggccggccgggccgggaugaugugaugaucuaauuguuucccuauugguuugauuggccgccaugauggcucaaacuguauuagcucuaucugaucaucuccuuggcgauccgac

SEQ ID NO: 7089 - RNA, 71 nt, Zea mays
caauggggacccgauacccgccaacccguggggaauuccccuauuagguuauggguaugggacgaaaauug

SEQ ID NO: 7090 - RNA, 119 nt, Zea mays
gcccggacuucgcugccuugagugggugcaggaggagcugcaggcgcuccccaccaucguggagggguuuaugucuuaugcuucucuggucaccugcgagggggcgaugaacgcgcucu

SEQ ID NO: 7091 - RNA, 111 nt, Zea mays
augcugcucuaggauggaugguuuuucugcgccucuacuucgcauccuuagacagaaaauuaugugccugcaugucccucacguaggagaguccauccaccgcgucucccc

SEQ ID NO: 7092 - RNA, 229 nt, Zea mays
ggguuugaagcggagcuccuaucauuccaaugaagggucguuccgaagggcugguuccgcugcucguucaugguucccacuauccuaucucaucauguguauauauguaauccauuggggggaggguuucucucgucuuugagauaggcuugugguuugcaugaccgaggagcugcaccgcccccuugcuggccgcucuuuggauugaagggagcucugcauccugauc

SEQ ID NO: 7093 - RNA, 117 nt, Zea mays
caguagcugauacgcugaacugaauggacuccgcacauccagagggaaguguuaaaacguuuggcaucauuuauagcuggcuggacuggaguauauucuguuagcguuuguucgguu

SEQ ID NO: 7094 - RNA, 63 nt, Zea mays
uacagguacugggugcgggaagccaccggcgacgccgcgccgcuccccgucccgcgcaagcuc

SEQ ID NO: 7095 - RNA, 87 nt, Zea mays
uucacgcucgggaaaacagccuuugucgagcguuguuauaugacgaguguuuugcacuuggcaaagguugucucugccgagugucgu

SEQ ID NO: 7096 - RNA, 228 nt, Zea mays
cacgaguuggugaagcugccagcaugaucugguuaugaugggggggguauauguaagauggauguaaucuauacuacuaccggccccuguuaauuucucucucucuccccggucccugacugucauauauggaucgacgaauccaagaugagaggggaauggagagagagagagaggguaauuaaugagcaccaggaccaggucgugcuguaguuucaucugcugggg

SEQ ID NO: 7097 - RNA, 197 nt, Zea mays
aagugaaagguauggaucucgcucaccuuacucgagaagcacaagguaccgaagucgcucuaggagugucgacucuagugaugcugaaaacccugggaacaaccuguaugugacugguuugucggcucguguaacggaucgagaucuggagaagcacuucuccacugagggugaggugauugaugcaagcguugugu

SEQ ID NO: 7098 - RNA, 239 nt, Zea mays
aucuccuuggcgcucuuuaacccuugcaccuuguuauacuccuguacuccaaucucaacaacaucccaaaugcuaguguggagugagguuagaugaugccucauuuuaucacuccacauauuauaaucuucaccaucaaacauaggugguuugcuaaacuucuugcgcucaugacgcuuagaaguuauggacggcgugucggagccggagguggauggcgauaaagagucggucucgua

SEQ ID NO: 7099 - RNA, 154 nt, Zea mays
auccgcgcuccgggccuccggcucuuuggcuuugauagcuuguccucgccccucgagcggagacgugggcgagggcauuguugcagcggcguccgcccuaaggccaucgcugcugcaguucggccacccggagcggaggucguggucgcugcug

SEQ ID NO: 7100 - RNA, 71 nt, Zea mays
ucggcuacugcggcacgaccgacgaguacugcggcgacgggugccagucgggcccgugccgcucgggcggc

SEQ ID NO: 7101 - RNA, 69 nt, Zea mays
cccacgccgaggucgacgucagcagcccggauggcaagaagggcuugcugggcaagaucauggacaaga

SEQ ID NO: 7102 - RNA, 65 nt, Zea mays
ucgaggagcugcacggggcgacucuguuccacgagagcauggggagccucgacgcagauuuccac

SEQ ID NO: 7103 - RNA, 73 nt, Zea mays
ggcgaacuggacuacuggugagucgcugcuggguuuucaugugcagcuagcgucacucagcuaacccccuguc

SEQ ID NO: 7104 - RNA, 261 nt, Zea mays
ucgaaggacggucgcgacgucaccccgugggcccugaagauucccgugcugccagcguguccgacagucgcugucacgggccggauccggaaucucgauauuucugcauuuccgcuccugcuucgccgugaaggagcccgacgcggacgacgaggaaaccggcgagcgggaggcaaccauggcuagcguucucgcgcucuaccgccgcucgcucgucgaacgcaccaagcaccaccucgguauguugcgccuuggacgcuc

SEQ ID NO: 7105 - RNA, 195 nt, Zea mays
cggcgcguccgagcccagccgacgccgagccaauggugacuccagcgacauucucccuccgccccagcgcgccccccgcgccgccucgugccgggcugccccgcgcucgggccuguuucgcgcccgccauccgcaccuccccuuccgucgccuuuuccuaccagccucggcgcuucaguggcauccgccgcgccg

SEQ ID NO: 7106 - RNA, 68 nt, Zea mays
gcgggggagaucguggcaccgucggggagccggcgcagcuggcugucggcggcguccaucucgcgguc

SEQ ID NO: 7107 - RNA, 89 nt, Zea mays
cuucgauaacgcgggaccggucggccgcaagcgucauaagcugcagcgugccuggcuugcuggcucagcuggcucuggcguggccuccg

SEQ ID NO: 7108 - RNA, 73 nt, Zea mays
gcgcuacccgggagcacauuacccuaccauccagccucuugccaggaggguaacugcuacucccaccaucucc

SEQ ID NO: 7109 - RNA, 119 nt, Zea mays; identical to SEQ ID NO: 7035

SEQ ID NO: 7110 - RNA, 79 nt, Zea mays
guccggcuggugcaucaacgggaacuagggccgcugcuacgacuucuggcuggaguucagcgagugcaugagccgcugu

SEQ ID NO: 7111 - RNA, 759 nt, Zea mays
aagaaagagagcgagaagcagucgccaugucuggcaucauccacaagaucgaggagaagcuccacauggggggcgaccacaagaauaaggaggaggaguaccacaagaaggccgaggagcaccacaagaaggaggagggggagcaccacaagaaggacggcggggagcacaaggaaggcaucguggagaagaucaaggacaagaucaccggcgagcacggcgacaaguccggcgaccacaaggagaagaaggacaagaagaagaaggauaagaagaagcacggcgagggccacgaccacgacggcggccacaguagcagcagcagcgacagcgacugagaucuggugucgcagcacaggugcaacacaaguaugcuugcuggauggaggauucauaccagcugaugcugauguaguguuucacuggugucaugcaugcauguaucgugcuauuauaaucaaaaagaaaaaagaaauaacagucagggaugguuuguuugccaugugaucuuguacacuccuacuuaaauuauggcugcugcacggugcugcuagcuugugcuaaaaaaguguugaucugcaugagagauucaaaccagggaugguuuguuugccauuuuaacuuggacgccacuaaugaauuuugcgaugcuacacagaacuaaaaaagguacaaauguaguguauuguguauuugccaugugaucuuguacacuccuacuuaaauuauggcugcugcacggugcugcuagcuuguacu

SEQ ID NO: 7112 - RNA, 176 nt, Zea mays
cuaccucaucgaggaggaggaggggcucaacgaccacaacgucgucgucaagugcgccgagauccagaccgcuaucuccgaaggagcaacaucguuucuuuucacugaguaccaauauguugguaucuucauguccaucuuugcuguugugaucuuccucuuccuugguucgguug

SEQ ID NO: 7113 - RNA, 74 nt, Zea mays
aguaacagcauccaucgauccacagugcaugcugguugaugcaugggucugcuggagccgaggaugaacacagc

SEQ ID NO: 7114 - RNA, 131 nt, Zea mays
aaggaccaaugucucaagcccagcccccucguucccaagcccaguggaaacacguuaaauuucaggauaaccaagcuaaugccaugaaggaaccaggaaccgguggguauggcuaugggacgaaaaaugac

SEQ ID NO: 7115 - RNA, 89 nt, Zea mays
gcauuauaggagacaggucgguaugcauguguggcaaguucuaaaacauaacuccagcuagcaugcaugcugauuuaucaauacuggca

SEQ ID NO: 7116 - RNA, 117 nt, Zea mays
uacucggacguggccgugcaguuccuggggauggagcaggaggaggagcagaggaacgagaccaggucuuuccugcugccgcucuaccccaaggcgcgucagggccgcgcacugcgc

SEQ ID NO: 7117 - RNA, 82 nt, Zea mays
cggagaagaagacuucuuguauugucucccugacagcaaggagauuucugucugucgggagaugagcaagaacuucggaucc

SEQ ID NO: 7118 - RNA, 77 nt, Zea mays
gagagauccuuggagucagcaauggagucuaccgcgcuaaugaccgcgagacuaccacugcugaccucuggcucccg

SEQ ID NO: 7119 - RNA, 86 nt, Zea mays
uguauugugcacggacuacuccguaugguggugggcgcaggaacgaccugccgccgacugcgacgcgacuagcuaugcgcgcacgc

SEQ ID NO: 7120 - RNA, 60 nt, Zea mays
uugacccaggaacauagcgugugugcauggcgcgcgacguaguguucgacaaagggcgag

SEQ ID NO: 7121 - RNA, 88 nt, Zea mays; identical to SEQ ID NO: 6734

SEQ ID NO: 7122 - RNA, 85 nt, Zea mays
cuaauaccgggcuugaugcaugacucacguaggaccccgauagugauguguccugcgagaccugcaccaagaccaacauggcgau

SEQ ID NO: 7123 - RNA, 135 nt, Zea mays
gcaucuuagacuaucuccagcagcuuacccauccccauacccauauucaaacucuacucugcgaacagcgcaaucuauaguacaaaacagugcuuuuggguaaacuauggguagacugcugcagacggucuuagg

SEQ ID NO: 7124 - RNA, 72 nt, Zea mays
aacucaagaugaggaugaagcucaaguugaugaaguagaagaucaagcaaaugagccaccucaagauaaugg

SEQ ID NO: 7125 - RNA, 167 nt, Zea mays
cgggggaaaauggggaagacgccggugcggaugaaggcggugguguacgcgcugucgcccuuccagcagaaggugaugccggggcuguggaaggacaucaccaccaagauccaccacaaggucaccgagaacuggaucuccgccacgcuccuccucacccccgucgu

SEQ ID NO: 7126 - RNA, 93 nt, Zea mays
gaggaggacgacgacgacgacagcacgcggcgaccuaaugcgaagcggcagguugugguugcgugcguguacgcguccucgaucgucgugcau

SEQ ID NO: 7127 - RNA, 65 nt, Zea mays
uguaacacccauguguuuauauucugcucgacaacgaguauggauuuaagcgcauaauaucagug

SEQ ID NO: 7128 - RNA, 102 nt, Zea mays
uacggguguuguugaggcgauugacgacugguucgagcuuuuuggucacgcacucgaugaauauuacucggcuagcuucgucuucacccgacgcacagaacg

SEQ ID NO: 7129 - RNA, 63 nt, Zea mays
uuccauugaaaguuugcucuuucguggauauuauccauuagagggcagccucauauuccaucg

SEQ ID NO: 7130 - RNA, 67 nt, Zea mays
acaggauccggcgacgacggccauggcggccaggcggacgucgguggccuccuugcccucgaggacc

SEQ ID NO: 7131 - RNA, 211 nt, Zea mays
cucaagguguccagcuucgucagcggcuaccagucggccgcgcugcccagcacgucuuucgucaaggucugcuccccgccgcugcccaacccggccccgggcagcgcggcggcgcccucggccggcggcuccggcguccgcgccugggucguggcggucgugguccugggugugguguccgcgcuggugcucugcgagugggcgcucuggu

SEQ ID NO: 7132 - RNA, 108 nt, Zea mays
aucccguuacccauggauugggugggauuggaaaaaauuaagaaaagguuugacuuaguugggauuuaaacucacccaaucccacucaauccauguggauugggagcu

SEQ ID NO: 7133 - RNA, 266 nt, Zea mays
agcuguggugugugauuuagaucgggucucugagggacucugcaggacugucacuaugucuugauuugcuguguuuacaccgugcuguucucauuuacguuuaauaguuugggccugaugccacgucucugguagcuacaugcuuugaccagagaugcuaugaucaggccgauacaaaagucguuucacauguugauaggaaccuggggacggcuucuccaucugucccacagagccgguuucugugaucacauucauucaucaau

SEQ ID NO: 7134 - RNA, 70 nt, Zea mays
uacucucgucaaccuucguccaaggcccauuauccucaagggaauaauguuccauggacgaaggacguua

SEQ ID NO: 7135 - RNA, 220 nt, Zea mays
gaucucagcagcguaucguauccgguguacaagcaaaaguccagcagcaggcccagcauucaagaucugaacucaucuccccacgagcacgcuccgaaaauccagagugcagaccacugcggcaugcuucaguugucagacgaaguucucgcacauaacauccuaucccgccugucaccaagagacguugcguccaucggaucggugugcaccagaaugc

SEQ ID NO: 7136 - RNA, 89 nt, Zea mays
acucugcaccgccgccguugacugcugauccaaccgcucccgcggcgcccggggcccugucacggaggcggcggcgacauggcgucgag

SEQ ID NO: 7137 - RNA, 78 nt, Zea mays
cccaggucuuggcggacuucguggcugaaugggucgacacccagcucccaacagcuccgauccagccggaacucugga

SEQ ID NO: 7138 - RNA, 69 nt, Zea mays
ccugcgggagcuaguugugguccuagucccugcggggggucaggacacacagcucgagcaaauccguga

SEQ ID NO: 7139 - RNA, 79 nt, Zea mays
ucucaggucuuggcggacuucguagcugaaugggucgacacucagcucccaacagcuccgauccagccggagcucugga

SEQ ID NO: 7140 - RNA, 71 nt, Zea mays
caggugccagguggugacuuuguaacgugugugcgugcguacguguacauugcauccaucuugguuccaau

SEQ ID NO: 7141 - RNA, 174 nt, Zea mays
augguagcauuugccggcaggaaguaugcagcuagaucuauuccgauauuuguauccaacaccucagucacaguguccagcuucacacugguacuugaguucaacaaaggcagacuccaaaacuugcacuggaagaaggacggcuguggcgcuugcuccggcaagucgaacuuc

SEQ ID NO: 7142 - RNA, 125 nt, Zea mays
ccugccuaaagcugcugcgguugucuuuguuguugaugcucaagauuucuugucuagcaugcaagcugcugcagaguaccuuuaugacauucugacaaaggcaacuguagugaagaaaaaggucc

SEQ ID NO: 7143 - RNA, 125 nt, Zea mays
cauacgcucccucugcgcccuuccauccauggccgcgaauccuugauguugagauccgggagcugaagcgggagaucucgcgggugcggcuaacagagcuggagcgggagcaggggcugaugaag

SEQ ID NO: 7144 - RNA, 72 nt, Zea mays
uggcacguguauuuccgaugguugcucucaaugagucaaugacaaagcuagcuguuggugaugcuauuggag

SEQ ID NO: 7145 - RNA, 108 nt, Zea mays
ucauuaucaagcagcucgccgagcccucuuccugaaagaauguuguacauauuagcauuugaacucuggccaguaucgcggaagaaguugggugcuguuugguucacg

SEQ ID NO: 7146 - RNA, 265 nt, Zea mays
cuuaugcugaugcugauggucgguggucgauuauauauacuggaacuucugguguaugcucuucucuucuggggagacguaauguaacgaagaagaaugugugucauuguggccugugguacaaacccugcuguguaugggccugucuauaagaaacagcgaugagcugugacguuauguuucugacaguuuauuuacuaaugagcacaucuuuaauuuacuagaacgaagagaaguugacggaacugucggacagaugcagcaa

SEQ ID NO: 7147 - RNA, 90 nt, Zea mays
ggggauucggacgaggcggccagugcucucuccucguagccagcuucuccuggacgaggcggccagugcucucuccucguagccagcuuc

SEQ ID NO: 7148 - RNA, 63 nt, Zea mays
augcagcaccucucgggccacccgggcgucgucacgcucagggccgucuucgaggaugccgac

SEQ ID NO: 7149 - RNA, 100 nt, Zea mays
cuagggaauaugccuggcucccuguaugccacucgcacggcuaccacacccccggugggccgcugcggcuggcgugcgaggugccaagcauggcccucau

SEQ ID NO: 7150 - RNA, 119 nt, Zea mays
  misc_feature (63)..(63): n is a, c, g, or u
ccagaguguggcugcagcaaaucccggccauggcaccggagcuccuccaggaacgcaaguccnccagcugcugcugcugcuugccauggcgguggcggauugcuagugcuaauguucca

SEQ ID NO: 7151 - RNA, 72 nt, Zea mays
acgacgccugcgcgccguugcuguugcccgccgcgccuggaggcggguucggcuucgcggcgggguagacgc

SEQ ID NO: 7152 - RNA, 105 nt, Zea mays
cuggcuuuguagagaaucugaguaucauuaggauuacgugcggaggaagauaaauguguccauaaggcuuaggaucuagaagauggcggauuccuacuauugcaa

SEQ ID NO: 7153 - RNA, 68 nt, Zea mays
cauaagcgacgauuugcucagggaagcugcaaggaggaucgacggcuucucuggcagggagauugcga

SEQ ID NO: 7154 - RNA, 82 nt, Zea mays
cggagaagaagacuucuuguauugucucccugacagcaaggagauuucugucugucgggagaugagcaagagcuucgguuuc

SEQ ID NO: 7155 - RNA, 118 nt, Zea mays
cugcagaaaacugaagcgucuucaucguccaaucaugcgguugccucugguccggcuaaggucuggcaaccggguguagaugcacuggaagauggggaggagcuucaguuugauccug

SEQ ID NO: 7156 - RNA, 68 nt, Zea mays
gugaagacaugggcggcgcuggcggcauggacgaggacgccccugccggcagcggcggcccuggcccc

SEQ ID NO: 7157 - RNA, 74 nt, Zea mays
agaaucccgaggggaagaaauccucuugcuauucaaaauugaauugcaaggggauuccucccccauggaugccu

SEQ ID NO: 7158 - RNA, 61 nt, Zea mays
gauccacgaguccuacuaccgcgacaugaccgucauguucggcaagugggaguucgacccc

SEQ ID NO: 7159 - RNA, 247 nt, Zea mays
  misc_feature (37)..(37): n is a, c, g, or u
  misc_feature (47)..(47): n is a, c, g, or u
  misc_feature (95)..(95): n is a, c, g, or u
  misc_feature (99)..(99): n is a, c, g, or u
auagcuggauuacauggagaggcggcaaugagacccncucccccccnccggaagggagacggagacggauggugcagugcaucgggugugguggnucgngcgcggcauguguguguggcuguacauauacauacuguacaugauugguucagugcaggguuucuguuccuucauugauuaguuauuauacuaauaaguacuaguaauuuuguaagggcuuguaguugcagucuccguacugguggua

SEQ ID NO: 7160 - RNA, 73 nt, Zea mays
cgggagacagacgcaugucagcuauugucucguuuucuaagcaacgagcgagagcugcaugcgcugguuagau

SEQ ID NO: 7161 - RNA, 64 nt, Zea mays
ucucccgcuugcugggcacggugaccaucgcuagcgguggugucaugcccaacauccauaaccu

SEQ ID NO: 7162 - RNA, 282 nt, Zea mays
cuggcauaguggagguagcggguauggcuguggugguggauggcgcaacuggggugacgggagcaggcagagugggugguggaguggaagcaguggugugaguggaggagugaggccgggaggcgagacgaugaacacgguaugcaaucugaucugacggagucuguggcugaucuccaagcucgaccugcgcagcggcugcugcugcugcuguugccgcugcacgggcugcucuguccguacgccgcuucuugcggccuuccugcugcuccaaguaaauug

SEQ ID NO: 7163 - RNA, 71 nt, Zea mays
gaguucagccuggcgcaccggacacuguccggugcaccaccggacaguccggugugccagacugagcuguc

SEQ ID NO: 7164 - RNA, 74 nt, Zea mays
cguaacagcauccaucgauccacagugcaugcuggcugaugcaugggucugcuggagccgaggaugaacacagc

SEQ ID NO: 7165 - RNA, 67 nt, Zea mays
cggggugacagagauguaugcuugcuggccagaaugauggcugcaaacuuguacaucgaucagauug

SEQ ID NO: 7166 - RNA, 66 nt, Zea mays
gggcagcagggucacugcgcgcgggcccugucgcacacgggggccacgcggcagugcccucuuccc

SEQ ID NO: 7167 - RNA, 170 nt, Zea mays
gcucggccacagcgaucgggccgggauggaugagcuggagauggacgaggaggucaggcccgaguuccccugccccuacugcuacgaggaccacgacgucggaucccucugcgcgcaccuggaggaggagcacccguucgaaccccaagccgcgaaucgccgccggcugc

SEQ ID NO: 7168 - RNA, 80 nt, Zea mays
uagaaaaaaaugucaacuacugacugaugaucuuuaaggauacacaagaacaucacgugugggugacauaaauucuuuuu

SEQ ID NO: 7169 - RNA, 181 nt, Zea mays
accgccgcguccgaccgcucgcccccggcgcgcgcgccuccugccuccacgcgcgcgggccgagacgcaugcgacgggcguuggcgccgaccgcgcggccgaggcgcuucuccaaagcgggcugcgccgugagucgcugccgcggcacgucgcgguggugauggacgggaacucgcggugg

SEQ ID NO: 7170 - RNA, 80 nt, Zea mays
gacuagucacgauuaggcgacgacuaggacgacuagucgaccccuagucgguccuagucggucccuggucguccuagacu

SEQ ID NO: 7171 - RNA, 148 nt, Zea mays
cggcggcuacggcaacuccgacgggaacuggaggaacugagcgguggggcccgcgcgugcaaguuauccugugugggugccgugauguuuacccuaguccagaggguuuaucuucguucgugucguguuugguguugcccaucugggg

SEQ ID NO: 7172 - RNA, 272 nt, Zea mays
cucccuggcugcugcgugugcgugcuucacuguuugguugucgucacguccagcucagauuccagcgucccuucgugcucugaucuaucuucgcgucgaugugcaagcgccuucgugcugguaucccuuggacccguuucgccuucgcgcgacacuggcugcgaguugaaguuaauuucgccgaguuacucggaugaaguccgaucgguguugagaguucgucaugugguggugugugugaagcucguauaguaccugccaagcacucgaua

SEQ ID NO: 7173 - RNA, 69 nt, Zea mays; identical to SEQ ID NO: 7027

SEQ ID NO: 7174 - RNA, 61 nt, Zea mays
cagaccgugccgccggugagcucauccgcucgggcgggugagcugccgucggcaggguacu

SEQ ID NO: 7175 - RNA, 82 nt, Zea mays
aaauuguguaaggacccuauguccuuguguguuaugugcaugguuggauguggaucuaaggacgaaggguacaauaccugcu

SEQ ID NO: 7176 - RNA, 72 nt, Zea mays
cuguguucauccucgguuucagcagacccaugcaucaaacagcauggacugcggaucgauggaugcuguuac

SEQ ID NO: 7177 - RNA, 237 nt, Zea mays
acgacugcuaugcaagcaguccuucugugcaagcgugcaagcaaaucaucucauccauuagaucaugauccaaccguaggucauauuuaacacuuaaacccuuucaccaccagcucaauaaucuuuauaaaaaaaauccuaacaaaccaugguuguaucuaugguuggaucguaaucuaauugauaaaaugguuuguuugcacgcuugcacagaaggacuauuugcauaacagucgu

SEQ ID NO: 7178 - RNA, 61 nt, Zea mays
cgagcgaauacaagucagcgugaacaguacggggguacuguucaucuauuuauaggcacag

SEQ ID NO: 7179 - RNA, 207 nt, Zea mays
auucuccccauuccgcgguuccgcccucucgcgugccuccaggucccuccucugcguaacugggcggccgcugauccgccgccaccgcucugugcccugcgucugguguuccggugacaagcguccaccugcaagauguuggaauaccaaaacguaguuggggggagacugaagcugaaggguaaagcgcuggacguaaaggauggu

SEQ ID NO: 7180 - RNA, 272 nt, Zea mays
cgcucggacggcggcggcggcggcggcggcggcggaggcggcggaggcaguggcggugcgaacguggcuaauguggucaccgacgcguucuucaacggcaucaagaaccaggccgggagcgggugcgagggcaagaacuucuacacccggagcgcguuccugagcgccgucaacaaguacccgggcuucgcccauggcgggacggagguggagggcaagcgcgagaucgccgccuucuucgcgcacgucacgcacgagaccggacauuucug

SEQ ID NO: 7181 - RNA, 106 nt, Zea mays
gugcgggccggcggcugcacccucuuguugaggcagucgcgggcgucgcaguacaucccugccguccucgcguccucgaacaagggguggcagcgccggugguucu

SEQ ID NO: 7182 - RNA, 126 nt, Zea mays
cuacauucaaaauuguaaguuguuguggcuuuucuagauuuguagcuuagacaguguguauaucuagaugcauagcaaaagcuaugugccuagaaaagccaaaacaacuuacaauuuggaauggag

SEQ ID NO: 7183 - RNA, 111 nt, Zea mays
agaugaauauguugaugaccaugaugagcauguugaguccuauagaucugaugaugaccagaaagauuuaacugagccaggacaugcaucgugguuggacaaaauucagca

SEQ ID NO: 7184 - RNA, 73 nt, Zea mays
guuuuauaaagcgcagugaacagcacgccgucgaugcccgccgguggcuugcuguuuuugcgcagccccaucc

SEQ ID NO: 7185 - RNA, 159 nt, Zea mays
aaccucauaacuggcauagcugaaaccguccucgggcgucacauggauuguggagaaugcagagccauggaucgcauucauggaguagccacaggguucaaagucaaaaucgcagaucuccaucucggggaugauuucagagaugccagagagcuuugu

SEQ ID NO: 7186 - RNA, 61 nt, Zea mays
cucgucaucuguguuuggucgucauagagaacagcuuagugucaccaagacuuucggaaac

SEQ ID NO: 7187 - RNA, 73 nt, Zea mays
cgacgaucuucgacgucgguggcguguugggaggaguccucgccggccacaucuccgaccgucuaaacgcgcg

SEQ ID NO: 7188 - RNA, 114 nt, Zea mays
gggguagagcgcggucgaccgucggccaugucgaggugcuuccccuacccgccaccgggguacgugcggaacccaguggccguggccgagccggagucgaccgcuaagcuccug

SEQ ID NO: 7189 - RNA, 128 nt, Zea mays
uaauucacagaaugcacacaauaagguaguuccugaauuugcaugaaugagaacuauuuucuccacuuuugguauuaguguucuucgagauuucaugggcauuggucaauugguguuucuguauaaga

SEQ ID NO: 7190 - RNA, 111 nt, Zea mays
uagagaagaggaggacgacgacgacgacagcacgcggcgaccuaaugcgaagcggcagguugugguugcgugcguguacgcguccucgaucgucguccauccgugaaaaaa

SEQ ID NO: 7191 - RNA, 198 nt, Zea mays
ggcggcggcgcccggcucugcucggacggacuccaccgaaggcucggcuccccucggacuccaccugcgacggccggcccucugccugcaccgacggugcccggcucccucggcauccaccagcggugcccgacuccaagaaauguacaagucacggcugcaggagcugugccagaagcggcgaugggcgccgccguu

SEQ ID NO: 7192 - RNA, 82 nt, Zea mays
ccggucgccgcagacgcaagcccgcccgccgcagcugacgccgcgaucugcgagggugcaagcuagcucuggccccgcugcc

SEQ ID NO: 7193 - RNA, 214 nt, Zea mays
gcaaaggaaaguucuaugccugauacuucugagcucuucacaaauguuuauaagaagggauucaacguggagucauuuggaccugacaggaaggaguugagagcuacucuucccuagguugggagcagaauggcaguccucaacaugauaugauagccaggagaaauaaacauugaugaagaaggccucagacauugcuggaauucuuuuguug

SEQ ID NO: 7194 - RNA, 224 nt, Zea mays
gcaaaggaaaguucuaugccugauacuucugagcucuucacaaaaaaaaaaaaaaaauguuuauaagaagggauucaacguggagucauuugggcccgacaggaaggaguugagagcuacucuuccguagguugggagaauggcaguccucaauaugauaugauauccaggagaaauaaacauugaugaagaaggccucagacauugcuggaauucuuuuguug

SEQ ID NO: 7195 - RNA, 72 nt, Zea mays
cuguguucauccucggcuccagcagacccaugcaucaaccagcauggacugcggaucgaugggugcuguuac

SEQ ID NO: 7196 - RNA, 72 nt, Zea mays
guaacagcauccaucgauccgcaguccaugcugguugaugcaugggucugcuggagccgaggaugaacacag

SEQ ID NO: 7197 - RNA, 71 nt, Zea mays
ugcccugcagguggugacuuuguaacgugugugcgugcguacguguacauugcauccaucuugguuccaau

SEQ ID NO: 7198 - RNA, 82 nt, Zea mays
cgucguccagcggcagccucucguagguggcguuggcgaacguggacgccaucaccaugacgggccccgccgcggugagcgu

SEQ ID NO: 7199 - RNA, 103 nt, Zea mays
cuugagcccgucgcggaugauggugagcaagauccccgacccggaguccaccgacaacgcugaguucaagaucgugcucaccaucauccgcgacgggcucaag

SEQ ID NO: 7200 - RNA, 199 nt, Zea mays
caucgaucaccuucaacuuucaaucauggcggacgucgaugucgaaccggagguugccgccggagcucccaagaagaggacguuccgcaaguacagcuaccgcggcgucgaccuagaugcgcuucucgacauguccacggacgaccucguccagcucuuccccgcgcgcgccaggagaagguuccagaggggucugaag

SEQ ID NO: 7201 - RNA, 108 nt, Zea mays
acuuguugaaggcaguggcggcgaguccuucauugucggagucggaggaggagcaauccgaaucccacuccuuuccgauaugugccucgcccuuggccuucuuguaau

SEQ ID NO: 7202 - RNA, 71 nt, Zea mays
uauaacgcaucgaucccguguaccccggcggcgccuucgacccgcugggccucgccgacgacccggacacc

SEQ ID NO: 7203 - RNA, 126 nt, Zea mays
gccgggcuacaccugcaccgucugaucuggacuagcuggcagcccccggcccaugcguccauuuauccgugaacauggguuuuggagugagcuagcauccaguucaucggucguuugaagagagau

SEQ ID NO: 7204 - RNA, 266 nt, Zea mays
gaaugaauuuagagaaacuuggaaaguaagacuaggaaagagauugggagcuuuaugugcaccucuggggcccaaaucuccucguacuugcaggcgaucagcauagcugaaacaccgaccagcugcagcucccuucgcaggacugguugcagcgagagguacugaucgaugauguacauggucaaguagagaguuuccggcaucagcucgaacuuuauuuuuuuucccacuuccccacuacccuuucaaguuuccuagaaauuacc

SEQ ID NO: 7205 - RNA, 113 nt, Zea mays
acaggacgcuggucggcgucgccaggcgccccgacgugccuggcagcuacucccuggagggcugccacgcuaccgucgugccggugcuugugagguccggucaggcgaaccca

SEQ ID NO: 7206 - RNA, 72 nt, Zea mays; identical to SEQ ID NO: 6942

SEQ ID NO: 7207 - RNA, 125 nt, Zea mays
auuucuucaggugcgaugcuggauacgaggccagggcggauguggugucuacgacaugcuguaagaagcucgucguggacaugcacuacgaggcgcgcauccaggccaucgucacuuaccacggc

SEQ ID NO: 7208 - RNA, 71 nt, Zea mays
uuggcuacugcggcacgaccgacgaguacugcggcgacgggugccagucgggcccgugccgcucgggcggc

SEQ ID NO: 7209 - RNA, 71 nt, Zea mays; identical to SEQ ID NO: 7208

SEQ ID NO: 7210 - RNA, 496 nt, Zea mays
uccgaauggggcgccaccaggcaggccgccgcgcccaggccgcccaccgucuccauggucguccgcgccuccgccuacgccgaugagcucgugaagaccgcgaaaacgaucgcgucgccggggcggggcauccuggcgauggacgagucgaacgcgacgugcgggaagcggcuggcguccaucgggcuggagaacacggaggccaaccggcaggcguaccgcacgcugcuggucacggcgccgggccugggccaguacaucuccggcgccauccucuucgaggagacgcuguaccaguccgccgucgacggccgcaagaucguggacauccuggcggagcagggcaucgugccggggaucaagguggacaagggccuugucccgcucgccggcuccaacaacgagucguggugccagggccuggacggccuggcgucccgcgaggccgccuacuaccagcagggcgcgcgguucgccaaguggcgcaccgucguca

SEQ ID NO: 7211 - RNA, 62 nt, Zea mays
acagcgguggccgcggcuacugugguugcugcggcggcuacgguggugguggcggcggauac

SEQ ID NO: 7212 - RNA, 90 nt, Zea mays
acgacguaucgcgcucgcgucgcgugcaaugcaaucaacgcccccgccccgucaccacaugcagcacccgacguggcccggcacgucacc

SEQ ID NO: 7213 - RNA, 62 nt, Zea mays
gcguccaucuucggccacgcgcugaacccuacggggaggcgcgcggcgacgaagcuccugcg

SEQ ID NO: 7214 - RNA, 252 nt, Zea mays
uauagccccaaggcagcuaggagccguuggagacaaucuuggaaggcaauuccugccuucugucgaguggcgcacuggacaguccggugcgccaccggaaagcuacuguagccuguccugugcgcgauuuccuuccaaaacgggcacagucaaccguugcagcucuuggcccguuggcgcaccggacacuguccagugcacaccaaacagucuggugccuccuuccgaccguugaagcugccacgcgucgcu

SEQ ID NO: 7215 - RNA, 68 nt, Zea mays
aaauuucuaagucgucgucgucguucgguucggagcggaucugaggcgacgauggcuggaggcggcgg

SEQ ID NO: 7216 - RNA, 130 nt, Zea mays
acaccgcggagcagcucgagguugugcgccaggucaagaagcacaccagggacuacuaccagauccucggccuggaaaaggacugcagugucgaggacgugcgcaaggccuaccggaagcucucgcucaa

SEQ ID NO: 7217 - RNA, 194 nt, Zea mays
ggacgaauccgcccacccgccgccuccacccuauuucgaugccaccaagaccaugcuucgcucccaguaugucucgcagacgggcaaacagaacccaggcacuaaccagcagcuggaaaucgagaugaccgcugagaaggcucgccgccucaucacaucugauuguggaggcggagguggcgaugccaagccag

SEQ ID NO: 7218 - RNA, 87 nt, Zea mays
cgacauuguagcuguugggcagggaaggccuggaucauguaauugccucuacccaggauccuuccucugcagacagcuccacacaaa

SEQ ID NO: 7219 - RNA, 84 nt, Zea mays
uacucccucuguuucuuuuuauuugucgcuggauaguucaauuuuauacuauccagcgacaauuaaaacgaaacggagggagua

SEQ ID NO: 7220 - RNA, 166 nt, Zea mays
uugauuuggagacagggaugaggcagagcaugggauggggcuaucaacaaaguggagggacuagcuugugaggcagaaagaaggugccagugguucccuggcgaaacgaugauggcaguguuguugcucccuccccugcacugccucuucccuggcuccgaucccc

SEQ ID NO: 7221 - RNA, 268 nt, Zea mays
gucgccgauagcgacguuccggcgcaucgugaggagcaggagcacggaggacuucagguggcugccguacgucaccacccugcucagcaccagccucuggaccuucuacggccuccucaagcccggcggccuccucgucgucaccgucaacggcgccggcgccgcgcucgaggccgccuacgucgcgcucuaccucgucuacgcgccaagggagaccaaggcgaagauggccaagguggugguggccgugaacgucgccuuccuugcc

SEQ ID NO: 7222 - RNA, 82 nt, Zea mays
cgucguccagcggcagccucucguagguggcguuggcgaacguggacgccaucaccaugacggggcccgccgcgaugagcgu

SEQ ID NO: 7223 - RNA, 88 nt, Zea mays
auaugauucaaacacaagggcauauagagucuuuaacaaguccucgggacuaguugaagucucaugugacguuguguuugaugaaacu

SEQ ID NO: 7224 - RNA, 86 nt, Zea mays
gcugcgcaagccgcggcgguugaccagcgcgcccucugcuccacuggucggaucgggccgcaggcgcccgccguggugccgacgaa

SEQ ID NO: 7225 - RNA, 66 nt, Zea mays
ccacgacgacuuguggccaugucuucugcgacacgugcaucaagcaggccaucaagguucagaaga

SEQ ID NO: 7226 - RNA, 423 nt, Zea mays
uuuguuuauuaggguagcgaugaacuaacagcguuuccgcaauuuauuucgcuuugaguauaccugguaaggcaauaugcaaauguauacuucugcuuguuuauguuugcuaggauuuaauaaaucaauuagcggcaauaaauacauaugcgugcguguauagccugaauuuuauuuagcucgaccauaauauuguauauaguuuacuuugauuugaauagaugggauaauaaccucuaaauaaauaaugcuaguuaaccauaauuuaauaccaugcaugugauaugcauaaaaauaguauuauuuuggaauaaucuacaagauguacuugcacgggcacaacacaugcaucuauuuauuagcuauuguuuacgguauuuuacuauagggugcguuguugguuuccgcaccuugauaaaaaaa

SEQ ID NO: 7227 - RNA, 89 nt, Zea mays
gacugucccgugugcggcaacggucagauccaacgguggacugcuacagcugcccacggucggcugacguggcgugcaccggacacucc

SEQ ID NO: 7228 - RNA, 91 nt, Zea mays
gaccccgucgagcgcuugaaggacggguuccauaaguucaagaccgaggucuaugacaagaagccggagcuguucgagccucucaaggccg

SEQ ID NO: 7229 - RNA, 153 nt, Zea mays
cgcagaaucgaaaguuagugcagccuccagaagggacauucuucuaacgaaguguucacuuggcccgucaugggauccaacaguaauugaaaguuuuaugggcuaaaaaacagcgucuacaucuggugccccugccuggcuuugugauuuuuu

SEQ ID NO: 7230 - RNA, 151 nt, Zea mays
auccaucaucgcgcgggcaguguugcugugaccgacauccucgaaaucaucagucgcauccuugccaguugaggacaacagaacaucaucaccuccuggguggucuaccaaaaacuucgucacaucauacaccuugccgccgaugaugagc

SEQ ID NO: 7231 - RNA, 83 nt, Zea mays
accaugugggagcggcagcacgagcucggcgcggagaagauguacucccucugcuccgagcucggcggucucuuccucaaggc

SEQ ID NO: 7232 - RNA, 106 nt, Zea mays
ucauaacaaugcucaucuugcccaucgagcuauaucgccugagacggucuuuauaacuucuaacggaucuuggaagcuugguggguuugguuuugcucuuucaguu

SEQ ID NO: 7233 - RNA, 138 nt, Zea mays
ccggacgguccgguguacaccggacauguccggugaauuauagcggacuagccguugugaaaucccaaagcuggcgaguuccugaggagccguuccuuggagcaccggacacuguccgguguacaccggacaguccgg

SEQ ID NO: 7234 - RNA, 70 nt, Zea mays; identical to SEQ ID NO: 7047

SEQ ID NO: 7235 - RNA, 85 nt, Zea mays
gcgucgacgacggagggagagggggaggaggagucgggcuccgccggcuccccuccuccuccuccuccucccccgacgcuggcgc

SEQ ID NO: 7236 - RNA, 267 nt, Zea mays
agcggcuagauuggcagagguucgcgaugaaaacucaaaacuaaaggauaaauuagacaugacaaacuugucauauggugaauuagcaaaggaacuuaaaucaguucaagaucaacuagcagcagaggguucaagaugccagaagcuugaggugcuaaaguuaaacaugcaauugauucucugauccugaaaauacuuauuuuccgguuuccuucuuaugcuucugauuacuugccuuuuuauccugaaucugucaacuuaguccca

SEQ ID NO: 7237 - RNA, 99 nt, Zea mays
cggcgaggacgugugguucaaggccgggucgcagaucuucagcgaggguggucuggacuaccucggcaacccgagccugauccacgcgcauagcauccu

SEQ ID NO: 7238 - RNA, 64 nt, Zea mays
cgcggaucagcgccgucgccgaucggaggcccucgcuuccgccggcgggcggcgcgagccggga

SEQ ID NO: 7239 - RNA, 111 nt, Zea mays
ggccgcuuucagcgcgagcggcgagauucugucagccgcugucgcuaaggacguggcgggcuccaugucccagcggcugagggaggcgucgcagcagcugucgcagcagcu

SEQ ID NO: 7240 - RNA, 142 nt, Zea mays
cacgggcucagguccggccguucuaagagauccgguucagcgaaggugggcgccuucccgucgcuggacguggugccgcugauggugacgaugguggagcacguggacaugucgcgggacuacgucgugaccaaguccaucu

SEQ ID NO: 7241 - RNA, 59 nt, Zea mays
aaccugcuuauggauuaucauaaucuagguaucuagauuauauaauccaccuaaaaaaa

SEQ ID NO: 7242 - RNA, 121 nt, Zea mays
cgcgaacaaugugggcaguggcaacguacacaaggcggacauggugaugaacggguugcccaucaguguguacgcauuggagacguuggggugugcggcggccacguccacagacaguuga

SEQ ID NO: 7243 - RNA, 250 nt, Zea mays; identical to SEQ ID NO: 6878

SEQ ID NO: 7244 - RNA, 257 nt, Zea mays
aagacuaucacccucgagguggagucgucugacaccauugacaacguuaaggccaagauccaggacaaggagggcauccccccagaccagcagcggcucaucuucgcuggcaaacagcuugaggacgggcgcacgcuugcugacuacaacauccagaaggagagcacccuccaccuugugcuccgccucaggggaggcaugcagaucuuugugaagacccugaccggcaagacuaucacccucgagguggagucuuc

SEQ ID NO: 7245 - RNA, 109 nt, Zea mays
agcucccaauccacauggauugagugggauuggggggcuuuaaaucccaacuaagucaaaccauuucuuaauuuuuuccaaucccauccaauccauguguaacgggauu

SEQ ID NO: 7246 - RNA, 111 nt, Zea mays
auggcggccuggaugagauucuaagcaaguugaacauugaagugucuccaacuuuaauccucacuggauuuggugcuuuuauugcuuuauggauccuaucuucuguuguug

SEQ ID NO: 7247 - RNA, 109 nt, Zea mays
gacuauggugcagccaaggaugacuugccgaucgacgugacgccucuugaucucgucgucgucagaucgucgccgaucaucggcaaguuguucuuggcuacaccguggc

SEQ ID NO: 7248 - RNA, 111 nt, Zea mays
cguaccauggacggcuucagcaggaugcccucgaacaugacguugugcuaggucgugcacacaagcaacuuccucuccggggcgauccugccgugccuguccacgaggaug

SEQ ID NO: 7249 - RNA, 135 nt, Zea mays
ucuucaguucucccgcugcugcugccgcugccacccuccguccgcguccagaucccgccaccccaaucgaucugccggccuccagcauggcggcgggggcgggggcgagggcgaaggcagcgggagcccuggcgc

SEQ ID NO: 7250 - RNA, 61 nt, Zea mays
ggaccaucagcggcugaucuuccccggccagcagcuggaggauggucgcaccuuggcugac

SEQ ID NO: 7251 - RNA, 71 nt, Zea mays
ccugaccuggaggagaagagcggcgggggcgcucaggccagcgccgccgccgucguccucggcguugcccc

SEQ ID NO: 7252 - RNA, 219 nt, Zea mays
ugacgucgcugcuggaggaggucagccgggagaggcgccccggccccggcgccggcgccggggagaucggugucgauccugagcucgacgaauucauggacgcuuacugccggguacuggugcgcuacaaggaggagcugacccggccguucgacgaggccgcgucguuccugagcagcauccaggcgcagcucagcgaccucugcagcggcggcagcu

SEQ ID NO: 7253 - RNA, 272 nt, Zea mays
gccgccauggagaacggcgugcuuacagucacugugcccaagggaggacgucaagaagccugaagugaaguccauucagaucuccggcuagaccucggucugcggucgucauaccugcgugguuugaggaacggcaguucgcccucggucguuccgugaaauaaaauuggguuacaagaaucauggcguuugucaauauggucguaaugucguaggaugguggaauguggucacaaacuuugcguauguugggucuacugguggugucugaa

SEQ ID NO: 7254 - RNA, 62 nt, Zea mays
gcauccggaagaggacgucgcggcggcucacgcagagcccccgcucgucgucguugaccagg

SEQ ID NO: 7255 - RNA, 80 nt, Zea mays
gucgccauggcugcagcaggcgaggaucggucggggucgggacaauacggcugguguucacucacucgcguccacaggcu

SEQ ID NO: 7256 - RNA, 75 nt, Zea mays
uaccacaggaugaggcgcuuggaggaugcugcgauguguucgugagaggucuaggccgucgccucccagucaacu

SEQ ID NO: 7257 - RNA, 110 nt, Zea mays; identical to SEQ ID NO: 6805

SEQ ID NO: 7258 - RNA, 259 nt, Zea mays
caagcuaaaaagaagggggcuaagcaagguccguuugaggcucguccgcgaucuaguucgaggaacuuuacugggacugguagacuucugacaggugaaacuguagagcguaaugcaucacagccaccagaagaaauuacccauaacauccacuucuggaggaauggcuucacaguaaacgaugguccacuuagaaguuuugaugauccagcaaaugcacccuuuuuaaaggaccuguuugggccucuuggcucuggac

SEQ ID NO: 7259 - RNA, 262 nt, Zea mays
ucgacaagcucaaggcugagcgugagagagggaucaccauugauaucgcucuguggaaguuugagaccaccaaguacuacugcacggucauugaugccccuggacaccgugacuucaucaagaacaugaucacugguaccucccaggcugacugugcuguccuuaucauugacuccaccacugguggauuugaggcuggcaucuccaaggauggccagacccgagaacaugcgucuccuugcguucacccuuggaguggagc

SEQ ID NO: 7260 - RNA, 398 nt, Zea mays
caagcgugugaucgagagguucgagaaggaggcugcugaaaugaacaagcgguccuucaaguacacgugggugcucgacaagcucaaggcugagcgugagaaagguaucaccauugauaucgcucugcggaaguuugagaccaccaaguacuacugcacggucauugaugccccuggacaccgggacuucaucaagaacaugaucacugguaccugccaagcugacugugcugugcuuaucauugacuucaccacuggugguuuugacagcuguaucuccaacgguggccauacccccuaacauucucuucuuugguuaacccuugggaugaagcuauucauuugcugcuggaacaagauguauucacccucuugcaauuucuucaugguucguuuuu

SEQ ID NO: 7261 - RNA, 65 nt, Zea mays
uaagccacgugcugaggcuuucguuggucucuucgccggcgacgagcacccagcaguucuguaga

SEQ ID NO: 7262 - RNA, 73 nt, Zea mays
acaagagcuugaccaacgacugggaggagcaucucgccguuaagcacuucucuguugagggucagcuugaguu

SEQ ID NO: 7263 - RNA, 66 nt, Zea mays
ggacacuggcagccaggucugcaaucuugcgugggucaaagaaugugaaugagcuuguuagcaccc

SEQ ID NO: 7264 - RNA, 84 nt, Zea mays
ggcgaaccuggccuggucccggggcacgccgcucucgcaguaggcgagguggcggccgucgcggagccugagccugggcgccgu

SEQ ID NO: 7265 - RNA, 60 nt, Zea mays
uuguuauaaaacuuuuaucacuuauauguugcauuaggugauaggaguugagugaugaaa

SEQ ID NO: 7266 - RNA, 89 nt, Zea mays
uggacaacugugaggagcugaucccagaguggcugagcuuugucaagggcauuguugacucugaggaucuuccccucaacaucucccgu

SEQ ID NO: 7267 - RNA, 78 nt, Zea mays
uagcaauuaagcaugugucgaguucagcucuaucaaaaucuacuaaguauagcugacccucuaacacacccuuaaaug

SEQ ID NO: 7268 - RNA, 269 nt, Zea mays
caccaccuuggcgggcggcagaggacgcgcuggggaagaagcacuacggcaagcgaacgucagagcgcucgguccgagcugguugacgcgagcagggaggagcagagccgagcggagggcugcucgcgcggccccaggcgccaggagagagccgcggacgagggaggaagaaagcucccugccgagcuugaggggcgcggccugcagaggagcgccggcgagcagcuaaggagacgaagcgauguccaaggcugcgugcuggagaaugg

SEQ ID NO: 7269 - RNA, 217 nt, Zea mays
uggccauuggcaucguuggugaugcuggugucagggcgaacgcucagcagccgaaguuguuuguuggcaugauccucauccuuauuuuugcugaagcacuugcccucuauggucucaucgucggcauuauccucucgucucgugccggccagucccgcgcagauuagaggcacguuucagaugucaacaccgugccgccgacaguugccuggucgua

SEQ ID NO: 7270 - RNA, 78 nt, Zea mays
ggaggacaagguggugggcgucaagguggagguggaggagcaccggagccaccaggacagacaccgccacaaguaccc

SEQ ID NO: 7271 - RNA, 170 nt, Zea mays
ccgcggggcuggacacugccugccgccgccguugccacggccggcgucgccucggugguggccaccaucaucuuguccgcggcggcggccgauguggucgaggagaggcugacggugcccaugacgaucgucgcuggcgcagcgucggcgggggcagugugccucgacgg

SEQ ID NO: 7272 - RNA, 82 nt, Zea mays
caugagacaagaagcuggagcacuuugacucuuugagaggcuuacuuuuaugcugucuaguuuuccaucuucuguugagucg

SEQ ID NO: 7273 - RNA, 93 nt, Zea mays
agcccgagcugcgcgccgucgccgucucccacaugcccugcggccacugccgccaguuccugcaggagauccgcggcgccgccagcauccgaa

SEQ ID NO: 7274 - RNA, 71 nt, Zea mays
aucucauguagcagcuguaugacuacaagaugguugagaaccgaucuguaguggaacaggcucaugaguuu

SEQ ID NO: 7275 - RNA, 235 nt, Zea mays
cccuucagagucgccugcaggccuugggugaccacgcgcgcggcagacuccgugaggcgcugcaucacggcgucaggcaggccuucgccgugcucgcuucccacuaugacguggaucuagagcgggucagcgagggguauugccuucccgacgaagaugaagcugcccuggccgaaguccagaggcuugacgcggcugccgugggcccaagcgcggugcuggcgaccaccuucga

SEQ ID NO: 7276 - RNA, 155 nt, Zea mays
ugguggcaccaagcauuagucaggaacugcauuacuugcaagaaagucacaaguacacugcauuacuugcaagaaagucacaaaauccauugcaagaucauacuuguggcuuucuugcaaguugugcaguuguugccucaagcuugcugccuccc

SEQ ID NO: 7277 - RNA, 73 nt, Zea mays
acaagagcuugaccaacgacugggaggagcaucucgccgugaagcacuucucuguugagggucagcuugaguu

SEQ ID NO: 7278 - RNA, 158 nt, Zea mays
gaugccguguugauucgucugcaguuacaugccuuccuucgggcgggcagccgagagaaagcagcaaauuagucgcuacgucuguccuauuugcucuuaauaucuuuuugaguuugccaaaguacuggugcugugaugaagaugcucaacuauuucua

SEQ ID NO: 7279 - RNA, 73 nt, Zea mays
cuuccauaucuucagcgagggcgggcuggacuaccuucggaaccccagccugauccacgcgcagagcauucuc

SEQ ID NO: 7280 - RNA, 199 nt, Zea mays; identical to SEQ ID NO: 7200

SEQ ID NO: 7281 - RNA, 87 nt, Zea mays
uuaacuucugcauauuaugcggguaaggcuuguuucuuuuagauacccuuccucagaccccgcacaaugcgcuacgacacuggauaa

SEQ ID NO: 7282 - RNA, 122 nt, Zea mays
agguaacaagcuuuguggccacuggacaccauguacauauugcagugcugaccgucgagcugauccuuaaacugaagaaagaggugacggguguugcgguggcuacauugcgcgguaacaaa

SEQ ID NO: 7283 - RNA, 217 nt, Zea mays
agguaacaagcuuuguggccacuggacaccauguacauauugcagugcugaccgucgagcugauccuuaaacugaagaaagagguggcgguggguggcucuacgaucaugaaaacgauguuuccuguuccauuucauuguauggcagcaguguuuuccuuuaacagauauaguuuucgcugcaggguguugcgguggcuacauugcgcgguaacaaa

SEQ ID NO: 7284 - RNA, 75 nt, Zea mays
uaaagcucgacgucgucgucaccucucucgccguccacgagucacggcgagcggcgucgacggcgggcggggguc

SEQ ID NO: 7285 - RNA, 83 nt, Zea mays
uggagaagaagacuuuuuguauugucucccugacagcaaggagauuucugucugucgggagaugagcaagagcuucggauucc

SEQ ID NO: 7286 - RNA, 61 nt, Zea mays; identical to SEQ ID NO: 6813

SEQ ID NO: 7287 - RNA, 86 nt, Zea mays
ccacggccacggccacggcagcaacccggcguccccucccuccccggccaccuucgccgcugcgccgccgccggccgcggccgcgu

SEQ ID NO: 7288 - RNA, 105 nt, Zea mays
gggauacgcggcagcgaugcgccgugcguucuggaccuggacgacgcggccaccguggcgggcggcgucgaggacaccuacggcgaggaucgcgccaccgaggag

SEQ ID NO: 7289 - RNA, 70 nt, Zea mays
agauugauagaaagagcacaucagggacuugucaguucuugggaagaucccuggugucuugggcuucaaa

SEQ ID NO: 7290 - RNA, 90 nt, Zea mays
cguuuuucgcaacgaacaugcccaauccacuacauuauguccaaaacucauguuuggggugguuucgcgcaauuucguugccgcacguca

SEQ ID NO: 7291 - RNA, 82 nt, Zea mays
cgaugcggauuguuggucgcuaugugccaaggacggaggcccagcguaguugggauauacgcggauccaacgaucgcuugaa

SEQ ID NO: 7292 - RNA, 82 nt, Zea mays
aggugcggauuguuggucgcuaugugucaaagacggaggcccagcguaguugggauauacgcggauccaacgaucgcuugaa

SEQ ID NO: 7293 - RNA, 146 nt, Zea mays
ccucucgcucgcgccacccucgucuacugcgacaauguuagcaugaucuaccucuaccaaucugcaccgacgcacgaagaauguggagaucgaccuccacuuuguccgugagcaugucgcuguuggcgauguucgcagccuccaug

SEQ ID NO: 7294 - RNA, 64 nt, Zea mays; identical to SEQ ID NO: 6854

SEQ ID NO: 7295 - RNA, 88 nt, Zea mays
cccgaguccgagcccugggaucgggcgaggcagaguucgucgucuuccggggcugagccugaguccgagcccuggggucgggugaggc

SEQ ID NO: 7296 - RNA, 152 nt, Zea mays
cuuggcagauuuuguaguuccgcuguccaaucgauuuguugguuuuaacugacuuugucaccuuuuuaguuugcaaaaauggacaaucuaagugacaaagccaguuaaaaccaacaaauugguugggcugcggaacuacaaaauuuguuggu

SEQ ID NO: 7297 - RNA, 104 nt, Zea mays
gugcugaccgccagcguccgcgccgaccuccgccccguguucgccuuccucuccgcggaccugggcgugccggagucggcgcaccggcgcguggugaucaagug

SEQ ID NO: 7298 - RNA, 82 nt, Zea mays
cggagcuccgugggcuccuccuucuugucgcgcugcgccauggcuccucgugcgccaggcagaaggagaccccgaaccaccg

SEQ ID NO: 7299 - RNA, 61 nt, Zea mays
ucuguccucggaucggagcuucucugcgcgccgcagccaagcuuccuuccccauggcgcuc

SEQ ID NO: 7300 - RNA, 78 nt, Zea mays
acagguugcagaggcgauucuguccuaaguuuccaugauacauccggagcuccuagucaguucgcauuugauauucaa

SEQ ID NO: 7301 - RNA, 87 nt, Zea mays
gaugaagaagauccgggccgugcugguggaccacgcccucgccagcggcgaggccgagaaggacgccagcgcguccguguucuccaa

SEQ ID NO: 7302 - RNA, 117 nt, Zea mays
ucuggaaagcaucagcauguucuucggccuguugagaagccacaggggaaugauggugucuugugugcaccaguuaagccaccagugccgaaugagcacucugauggagccaugccg

SEQ ID NO: 7303 - RNA, 95 nt, Zea mays
gacuagguugcuuuuuuggaguuuucagagcagcaaaagagguacuccaaaaaauuguacugcagcuccaaaaacuccauagaguuuacaacucu

SEQ ID NO: 7304 - RNA, 89 nt, Zea mays
cgcagaggaaggaagggaucgccgccgugaagccagaagcuacggagucguucgacgugggcggcggucucuucuucgacauggccuuc

SEQ ID NO: 7305 - RNA, 167 nt, Zea mays; identical to SEQ ID NO: 7125

SEQ ID NO: 7306 - RNA, 99 nt, Zea mays; identical to SEQ ID NO: 7086

SEQ ID NO: 7307 - RNA, 83 nt, Zea mays
uuaagagaggacuagguauauacccgugcguugcaacaggggacacuugcgcacgcauaggucacuauuuagugaugcuauca

SEQ ID NO: 7308 - RNA, 83 nt, Zea mays
caagcuggagccggagcgcaaggcgcggcuggcgcgcgaccucggccugcagccgcgccaggucgccgucugguuccagaacc

SEQ ID NO: 7309 - RNA, 129 nt, Zea mays
gggaggccggcggggacgggugcggguggccguggccguggcccugggaguuggugcgguggagccggcacuugaacgacccggcgugggucgcgggcgcgcacacgcacuuggccccgccgccgccgc

SEQ ID NO: 7310 - RNA, 81 nt, Zea mays
guuuugauauucuaguauuuacaccaggacugggguguauauuacacauguguauuggagugaauacuagaauauguuuau

SEQ ID NO: 7311 - RNA, 84 nt, Zea mays; identical to SEQ ID NO: 6851

SEQ ID NO: 7312 - RNA, 83 nt, Zea mays; identical to SEQ ID NO: 7285

SEQ ID NO: 7313 - RNA, 80 nt, Zea mays
acaauucuccuaugucgccuccacuguuucuucucguccuuacugcgaaugaaaugguggggcugcuaguuagaucagug

SEQ ID NO: 7314 - RNA, 174 nt, Zea mays
guucggcgugcccauggugcccuggccgcuguacgccgagcagcaccugaacgcguucacgcugguggccgccaugggcgucgccguggccaugacguggacaggaggagagguaacuucguggaggcggccgagcuugagcgggccgucagggcgcucauggguggcgacaac

SEQ ID NO: 7315 - RNA, 219 nt, Zea mays
uugcucacauguacaagaccgacagggccaaguaugaguccaccgcacgcuccuggacacagaaguaugccaugggcuagaagcaaggcuaaaagcuggccaaacuggugaaugugccggaccccaaaucguuaucaccuaaauaaccagucaagucacaaguaugaauggacuuuugaggaccauugugcccuguugaacucauguauuaccuuguga

SEQ ID NO: 7316 - RNA, 198 nt, Zea mays; identical to SEQ ID NO: 7191

SEQ ID NO: 7317 - RNA, 72 nt, Zea mays
gacucaaaaugaggaugaagcucaaguugaugaaguagaagaucaagcaaaugagccaccucaagaugacgg

SEQ ID NO: 7318 - RNA, 102 nt, Zea mays
uggccacggcggccauggauugccagcgucucgauguggcaaaggacuguauuggaguccuuucaaagcaauuuccuggcagcacccggguugcccggcuag

SEQ ID NO: 7319 - RNA, 171 nt, Zea mays
auguuguggacgccgaggugagggaacucguggagaaggccuacucuagagcaaggcagauaaucaccacgcacaucgacauccuccacaagcucgcccagcuccugaucgagaaggagaccguggacggggaggaauucaugagcuuguucauugacggccaggccgagc

SEQ ID NO: 7320 - RNA, 121 nt, Zea mays
ggugccggagugcgcagugagccggagcuccgagaaguuagcgaugucggagccguugcgcauggaacgcgccagcugcaggaacucgccggagcccucugaugacucccacuccggcaug

SEQ ID NO: 7321 - RNA, 101 nt, Zea mays
guuugacgagcagcagcaauagacgugggguggauggaggaaaccgaggcaguugcagaacagcgagugucguucuuaugcuaugcugcugacuaucuuuu

SEQ ID NO: 7322 - RNA, 179 nt, Zea mays
agauccagccgggcugcggcgcuggccggauggccgagcagggcggcgcagccggggaggccgcuggcagcgaccccccugcgccugcgccugcgacugccccggcgccagccccagcgcuugcugcggacgcggccgggcagaggucccugccgacgccguuccugaccaagacguac

SEQ ID NO: 7323 - RNA, 79 nt, Zea mays
uggaccucgauugguuucuucuuaccuaggaacauccggggaugucgacuccugcgaggaagaggcugaugagggauuu

SEQ ID NO: 7324 - RNA, 202 nt, Zea mays
ggaagauacuuaggccccguuucaaucucacgggauaaaccuuagcuugcugcuaaacuuuagcuauaugaauugaagugcuaaaauuuagcuucaauuaucaccauuagcucucauguuuagauuacaaauggcuaaaaguggcuaaaaaaaagcugcuaaaguuuaucucacgggauugaaacagggccuuaauuucauc

SEQ ID NO: 7325 - RNA, 113 nt, Zea mays
gggcgguaugugucggauauugguguccggcgugauguugucaaggucccugucgaaaggcuuguggagcagaauguuacuuggauuccucaguguguggcuacagagacaga

SEQ ID NO: 7326 - RNA, 194 nt, Zea mays
ggacgaauccgcccacccgccgccuccacccuauuucgaugccaccaagaccaugcuucgcucccaguaugccucgcagacguccaaacagaacccaggcacuaaccagcagcuggaaaucgagaugaccgcugagaaggcucgccgccucaucacaucugauuguggaggcggagguggcgaugccaagccag

SEQ ID NO: 7327 - RNA, 294 nt, Zea mays
cuugcgaguauuuggcauucucguuugugucauauuaauuuuggcucuaugucucggcuugcaaccaugaguuuaauuccgaauaucaccauagucaaagguucuaagugccauaguugugugcagucgaagcuaccucgaaagccucauaaggcugcugaggagagacaccuggcaccgcuagaacucauacauucugaucuuugugagaugaaugguguguugacaaagggugguaagagauacuucaugacauugauugaugaugcgucuagauuuugcuauguauacuug

SEQ ID NO: 7328 - RNA, 174 nt, Zea mays
gcuccgccuccgcgguggucaguaagccaugguucauuuaagcugcugcuguaccuggguaucugcgucgucuggugcccucugguguaccucuauauggaugucgucgucuaauaaacaucugugguuugugugucaugaaucgugguuguggcuucguugguuuaauggccc

SEQ ID NO: 7329 - RNA, 91 nt, Zea mays
ucaggcuccgcgguggcaucauugagcccucgcugcaggcgcucgcucgcaaguacaaccaggacaagaugaucugccgcaaaugcuaugc

SEQ ID NO: 7330 - RNA, 69 nt, Zea mays
ggcggaggcgguggcgagggugaagacgucggcgcaggacaucaucaaccucaagccacucaucgacaa

SEQ ID NO: 7331 - RNA, 215 nt, Zea mays
ugucugucggcuggcugcuggcauggcaugauauacauucuaguuaucuugaaccaaaggcgacuguccguagaguugcuugcucuugcuucagcaggugggaauggcgccgugcacuucgguucgccugucucaguuaccagaggagagccuaaucccaucgucgcucggaugucagcaucaacgaccagcgcggcagccagcaugcacaggcg

SEQ ID NO: 7332 - RNA, 112 nt, Zea mays
gcuuugguuguguugucaucaaucaccaaaaagggggagauuguaaggaaaauggaccccgggccauuuggcuaaaugaguuuugguguuugaugauuaacacaaccuguga

SEQ ID NO: 7333 - RNA, 68 nt, Zea mays
acaggagaaaaggggagagagaggugaggcgcgguguccgcccgaucugcucugccccgacgcagcug

SEQ ID NO: 7334 - RNA, 456 nt, Zea mays
gacaggagaaaggggagagagaggugaggcgcgguguccgcccgaucugcucugccccgacgcagcuguuacgaccuccucagucucagucaggagcaagaugggugccggcggcaggaugaccgagaaggagcgggagaagcaggagcagcucgcccgagcuaccgguggcgccgcgaugcagcggucgccgguggagaagccuccguucacucugggucagaucaagaaggccaucccgccacacugcuucgagcgcucguccacgaccuggugaucgccgcggcgcuccucuacuucgcgcuggccaucauaccggcgcucccaagcccgcuccgcuacgccgccuggccgcuguacuggaucgcgcaggggugcgugugcaccggcgugugggucaucgcgcacgagugcggccaccacgccuucucggacuacucgcuccuggacgacgug

SEQ ID NO: 7335 - RNA, 71 nt, Zea mays; identical to SEQ ID NO: 7009

SEQ ID NO: 7336 - RNA, 214 nt, Zea mays
cccgacuaccuggacggcucgcuggucggcgacuacggguucgacccguucggucucgggaagcccguggaguaccugcaguucgaguuggacucgcuggaccagaaccuggccaagaaugaggccggcggcaucaucggcacccgguucgaguccuccgaagucaaguccaccccguugcagcccuacagcgagguguucggccuccagcggu

SEQ ID NO: 7337 - RNA, 63 nt, Zea mays; identical to SEQ ID NO: 6697

SEQ ID NO: 7338 - RNA, 80 nt, Zea mays
cccaggacagacugcgcacuugaccguacggugcaugaaugcucuguaccgucugcaggugaugcgcggugaggcgaugu

SEQ ID NO: 7339 - RNA, 220 nt, Zea mays
ucuuaugcaaucacuuauauuggugcaagcguacaaucaagcgguuuguuaaaucuaaucuaaaucuaaugaugacuguuauuuuauauuuaaccccuuccaccuaaaauauaguaccuauuuuacuuuuaaccucuuccauauaaaaccguuggaucuagauuggaugcucuagauaguuugauugcacgcuugcaccaaaaugagugauugcgcagga

SEQ ID NO: 7340 - RNA, 108 nt, Zea mays
auuccuaucccauguggauuggaugggauuggaaaaaauuaugaaagauuuuaacuuguuugagauugaaauccauccaaucccaccuaauccacaugaauuaagagc

SEQ ID NO: 7341 - RNA, 219 nt, Zea mays
gaguggaggagggcugcugaugggcggaggagacgaccggagagcggcggcgcuccagcgauccucgucgccauggagcgugggcgagcgguggcgggcgcacgccgggaugguccucgucaugcucgccuacagcgguuaccacguccucgccaaguccguccucaacgugggcaugaaccaggucgucuucugcgucuaccgcgaccuccucgcgcu

SEQ ID NO: 7342 - RNA, 103 nt, Zea mays
uucuuugaugcucaucgacguuggacuccauucaagcaugauuucaggaguucgcuuauugcauucagaaguggagccaaaaucagaaaugggccaccaaaga

SEQ ID NO: 7343 - RNA, 81 nt, Zea mays
guaauuuauggucuagucagacuaauguugauggcaagcaaucugaccacucagcacaagaugaugaccgcacaccacaac

SEQ ID NO: 7344 - RNA, 72 nt, Zea mays
ugcuccggggggccgaacagcggcagcacugaccucagggcggaugcugcugcuaggaggcccccgcccaug

SEQ ID NO: 7345 - RNA, 61 nt, Zea mays
cuaccuggccgccguccucgaguaccuggccgccgaggugcuggagcuggccggcaacgcu

SEQ ID NO: 7346 - RNA, 105 nt, Zea mays
cggggccguggcgugccggagcgcgugcgaggcguucgggacgccgcaguacugcugcagcggcgcuuaugggaaccccagcacgugccggccgucgacguacuc

SEQ ID NO: 7347 - RNA, 70 nt, Zea mays
gcugcauaacaacgaagagaaggccuguugccacaauaaggaccaggaaucucuucgcugacugagcaug

SEQ ID NO: 7348 - RNA, 75 nt, Zea mays
ggaugaaggaccucgcagucggcgagcucgcggccggccaagccgcgggucgucacgcugcaggugaucgagaag

SEQ ID NO: 7349 - RNA, 68 nt, Zea mays
ugccccaagggcgggccgcgcugcgacgccgacgucacgucgcagugccccgccgcgcugcaggcccc

SEQ ID NO: 7350 - RNA, 100 nt, Zea mays; identical to SEQ ID NO: 6981

SEQ ID NO: 7351 - RNA, 357 nt, Zea mays
aagacaucugccgcgacguccaccgcuccgaccccgacuggaagaucauacugcucagguacuucaaccccguuggcgcucauccaagcggguacaucggcgaagaccccugcggugucccgaacaaccugaugcccuacgugcagcaagucgcuguugggagguuaccucaccucacggucuacgggacggacuacagcaccaaggaugggacuggggugcgugauuacauccacguugucgaccuggcugacggccacauagcagcccugaggaagcucuacgaagacuccgacaaaauaggcugugaaguguacaacuuggggacuggaaaggggacguccguguuggaaaugg

SEQ ID NO: 7352 - RNA, 70 nt, Zea mays; identical to SEQ ID NO: 6770

SEQ ID NO: 7353 - RNA, 62 nt, Zea mays
ggggccggacuuuggggacgacgugggcaauggcccgcacucguuccugcagggcaacaagc

SEQ ID NO: 7354 - RNA, 114 nt, Zea mays
accaacccccgaucgagcggaucaguaucauauccaacuguagaguagggagaaucagucaaauucccccguuguagcuguaggcuuggcguugcugcucgaucgcgcuccugu

SEQ ID NO: 7355 - RNA, 140 nt, Zea mays
aacguuuggagcaaggugaacucaagcuucgugucagaacgcuggaaucagaaagagcauuucaaagaguugccgcuguacagaaaacaauuggauauggaguugcugcagguaguuugaugaaccuugcaacaauguug

SEQ ID NO: 7356 - RNA, 137 nt, Zea mays
guggaucccggccaucaagagcgacgccgagaucgugaacccgcccuggcucgacggcucgcuccccggcgacuucggguucgacccgcuggggcugggcaaggacccggcguuccucaagugguaccgggaggcgg

SEQ ID NO: 7357 - RNA, 336 nt, Zea mays
cgugcugugggcgcagggccggcgcgcgcuggcgcuggcgcuccagucccgcgucgccgaggucuucgccguggacauccacccggccgccaccgucggcaggggcauccugcucgaccacgccacgggcgucgucgucggggagacggccgucgugggcgacaacgucuccauacuccaccacgugacgcugggcggcaccggcaaggcggugggcgaccggcaccccaagaucggggacggcgugcucaucggcgccggcgcgaccguccucggaaacgucaggaucggcgccggcgccaaggucggcgccggguccgucgugcucaucgacgu

SEQ ID NO: 7358 - RNA, 93 nt, Zea mays
acgcgcggcuucaccgcggugcucgacgccgccggcacggccuacagggcgcgcuucgccggcggccucgucgccaccgucgucaggcgccgc

SEQ ID NO: 7359 - RNA, 88 nt, Zea mays
gguacucccuccguuucguuuuaguugucgcuggauaguucaauuuugcacuauccagcgacaacuaaaaagaaacggaggaaguauc

SEQ ID NO: 7360 - RNA, 99 nt, Zea mays
ggccugaccgucgacgucgacgccaacgggagaaagggcaagggcaagggaguguaccaguucgucgacaaguacggcgcgaacgucgacggauacagg

SEQ ID NO: 7361 - RNA, 71 nt, Zea mays; identical to SEQ ID NO: 6940

SEQ ID NO: 7362 - RNA, 79 nt, Zea mays
caaggacgcggugcuggacggcggcaucccguucaacaaggcguacgggaugacggcguucgaguaccacgggacggac

SEQ ID NO: 7363 - RNA, 79 nt, Zea mays
cgaggcgacccugcgcaugacccgacagugccaaccgagcacaucggucacgggucagucagccgcgggagaaggcgcg

SEQ ID NO: 7364 - RNA, 62 nt, Zea mays; identical to SEQ ID NO: 6779

SEQ ID NO: 7365 - RNA, 85 nt, Zea mays
uuauaguacgacgauuccuauacucaaguuaaauaaaauauaauuaaguaaacuccuugagucauuggugucucaugugugauuu

SEQ ID NO: 7366 - RNA, 246 nt, Zea mays
aagucacuugagcgugauguugguugcaacuuugaguuuauaagcccuccguccauagaagaagugcuggagucaucugcugagcaugucauugcuacauugagaggugugcacccagagucaacuaaauacuuucuuggagcugcugagaaauuaacagaagaauugggaccucaugcucuugcuucugcacuggcacaucugaguggauuuucucagccaccuucgucacguucucucaucagu

SEQ ID NO: 7367 - RNA, 234 nt, Zea mays
aggaauugaaccgacgcgcagucucagugaugaacuuguguuuuuuuuuagccugguagguuucaccuuuuuuagguguguguagugauuagcucaacgguguucuggacaagcaucaagauguguguaccugauugguguauacaaauugucccuguaauuuaucuguacauaugcaaaugcaaccaacuccaagcuuucgaucauugggacgaguagucugguuucuugucu

SEQ ID NO: 7368 - RNA, 231 nt, Zea mays
aagguuguugagguugaugcucuugcuaaggcauuggcuggucaaaaggaugaggcuuacuucgcagcaaaugcugcagcucaggccucgaggaaauccucaccccgugugaccaaugaagaaguccagaaggcugcugcugcucucaagggcucugaccaccgccgugcgaccaacguuagugcuagauuggaugcccagcagaagaagcuuaaccuccccauccuuccc

SEQ ID NO: 7369 - RNA, 82 nt, Zea mays
cgcgcgacaggacgcagacccccgcguggcgcaggucgacggccgacacgaggcgcgcgggcaggggcugcggcggcguggg

SEQ ID NO: 7370 - RNA, 102 nt, Zea mays
cuaauguuacugccauguucucagccucaguaugcuccaugguaggggauggugcuggaacacuguuuuggacugaccgcugguugcauggccaauguaucu

SEQ ID NO: 7371 - RNA, 95 nt, Zea mays
uucaugugaugucguggccgucggaggagugcuugagccguguggaacccgaggucgggcgaggcggaggcuccuccgaggucgaggucgagucu

SEQ ID NO: 7372 - RNA, 152 nt, Zea mays
cauacggacccacuccuccuuugcccuggugcgagcaggcuucggcagcaaaccccgcaggcugcucccggacgagggagaacgcgcggggcugggcuagccgcuaagcgcuagccagggaaccgggggcggaggcagcgaggagguacgua

SEQ ID NO: 7373 - RNA, 74 nt, Zea mays
ucaagcuucgccuuagccuuaucucgucggucacgcucgccagauguucgaucaaggacuuuagccgaaggaug

SEQ ID NO: 7374 - RNA, 84 nt, Zea mays; identical to SEQ ID NO: 6851

SEQ ID NO: 7375 - RNA, 121 nt, Zea mays
uagcgcacugcagagccugagaaccagauugcuguagucgauuugcgagggguucucuuuuuuuuuuuuugguaccuuucgcgaggaacucgccauuguuuuuggguacugaagcauguac

SEQ ID NO: 7376 - RNA, 70 nt, Zea mays; identical to SEQ ID NO: 6857

SEQ ID NO: 7377 - RNA, 69 nt, Zea mays
uuggggccagggccgccgcugccagcggggcguccucguccaugccgccagcgccgcccaugucuucac

SEQ ID NO: 7378 - RNA, 70 nt, Zea mays
uuggggccagggccgccgcugccggcaggggcguccucguccaugccgccagcgccgcccaugucuucac

SEQ ID NO: 7379 - RNA, 78 nt, Zea mays
uagaaagguggugggagugcauaauuugggaaggcuuggagacaccuugcccaagauaguucucugauuauuggcuuu

SEQ ID NO: 7380 - RNA, 89 nt, Zea mays
uuguccagcucauugcagccucuuuugaugucuacaacauuuugugcagcaaaaauaugacaccaaaugggaugcaagauucuucuucc

SEQ ID NO: 7381 - RNA, 73 nt, Zea mays
aggcucccaugccucaggauaacgagggcuacauuuuguacccugccggcuauccugagagcaaaauuaggag

SEQ ID NO: 7382 - RNA, 228 nt, Zea mays
ucgaccucaagaaaggcggcaacgggcgcuaccucaagacggcggccuacgggcacuuugggagggacgaccccgacuucaccugggagguggugaagccccucaaggcggagaagccgucuucugcaugaggcgccuccucuguuucggaagaagcuuuuggucuggucugccugcgcucuaucaugcuuuuuuauggcuccuacguguugugauucuugaucugcc

SEQ ID NO: 7383 - RNA, 105 nt, Zea mays
gcagcggcauccaucgggccggcgcccggcgcgcggccggcuggcacgaagucggcgaugccagcgucgcgcgcgcuguggugcugcccguagcgaaggccgcca

SEQ ID NO: 7384 - RNA, 73 nt, Zea mays
gggauccaugggggaggaauccccuugcaauucaauuuugaauagcaagaggauuucuuccccucgggauccc

SEQ ID NO: 7385 - RNA, 64 nt, Zea mays
cgcggaucagcgccgucgccgaucggaggcucucgcuucccccggcgggcggcgcgcgccggga

SEQ ID NO: 7386 - RNA, 139 nt, Zea mays
aucgccgaccuggagagccucucuaaggaggugccagacgugaagcgucacgccggcaacuucgagccagcggagacgguuaaguucaucccccucgaccccagcagcgacgccuccaagaagguucccuacccucugc

SEQ ID NO: 7387 - RNA, 81 nt, Zea mays
uagcauuuaaggguguguuagagggucagcuauacuuaguagauuuugauagagcugaacucgacacaugcuuaauugcua

SEQ ID NO: 7388 - RNA, 72 nt, Zea mays; identical to SEQ ID NO: 6942

SEQ ID NO: 7389 - RNA, 99 nt, Zea mays
cccuccugacagcugagcuccacgcucuccaaccauugugucauaucccuggagcgccgagcugaugaacuugugagcguuugccaguugugcggcaga

SEQ ID NO: 7390 - RNA, 300 nt, Zea mays
cuucagcuaggcaggagggcacaggaaggaggagauggcgucaaagaggauucagaaggagcucaaggaucugcagaaggacccucccaccucgugcagugcagguccuguuggugaagacauguuccacuggcaggcaacaauaauggguccaucugauagcccauauucugguggaguuuuccuagucacaauccauuuuccuccugauuauccuuucaaaccaccaaagguauaucaaacaagcauuuaggcaaugaucauuccuuauuuuuugugugcauuuuguccuuauuuguu

SEQ ID NO: 7391 - RNA, 95 nt, Zea mays
cgcgugcacuccuucugcaagacauugacagccucugauaccagcacucaugguggauucucggugcugcggcgccaugcagaugagugucuucc

SEQ ID NO: 7392 - RNA, 77 nt, Zea mays
gcgggagaugcgccagcggaugcucgaggcagccuuggugacgguugaccucggcacacgggggcgcgaccucgccc

SEQ ID NO: 7393 - RNA, 76 nt, Zea mays
guguuguguugugugggugcagcacgguagcaggcuagccaugugcccugcuguguugugucaccauccaucuaua

SEQ ID NO: 7394 - RNA, 75 nt, Zea mays
guucgacguugccgauaaccuguuucgaggcgccgugauuggcgcucuugccaacaaguauguugauucuuaucu

SEQ ID NO: 7395 - RNA, 72 nt, Zea mays
guacguggccuucgggagcuucacagucuucgacaccgcaaggcuccaggagcucgccgacgggcuggcgcu

SEQ ID NO: 7396 - RNA, 97 nt, Zea mays
aagucaaaucacaucuucagucugugcaggcuguuuauucaguuucagucaauaaggcuuagcuuguaguguguguggucugaagguugcaugugca

SEQ ID NO: 7397 - RNA, 108 nt, Zea mays
auucuuaucacauguggauuggaugggauuggaaaaaauugugaaagauuuugacuuguuugggauugaaacccauccaaucccacccaauccacauggauugagagc

SEQ ID NO: 7398 - RNA, 69 nt, Zea mays
acaagggacacgggugauuuguuuuaccgagguucggcccucgaaggccuaguccccguugaggagucc

SEQ ID NO: 7399 - RNA, 234 nt, Zea mays
gucgaguggcuccagagugccgagucugaugaagagggugacgacgagugaagaggccacgcugcucuacugcuaauggccgaacuugauaauauuauuucaauaaguuuguuuugcuugccuggugugucgguguuuaaaacuguuaauugucguguggcgcacgcauacucuuaugugucgucgucaguuuguuugugucgucaguuugguugucuguuggaugucacgguu

SEQ ID NO: 7400 - RNA, 85 nt, Zea mays; identical to SEQ ID NO: 7028

SEQ ID NO: 7401 - RNA, 205 nt, Zea mays; identical to SEQ ID NO: 6907

SEQ ID NO: 7402 - RNA, 69 nt, Zea mays
ggggccugcagcgcggcggggcacugcgacgugacgucggcgucgcagcgcggcccgcccuuggggcac

SEQ ID NO: 7403 - RNA, 427 nt, Zea mays
gcuugguauuuauuuagagccuguaguccuugauguuauuguggaaacagcccucgccucgauccauuugguaaaauacucgacagcgacgaagaggaugcaaaaguauggguugaagaugaauccccucaagugcgcguuuggggugucgauugggagauuuuuaggcuuuaucgugcaugagcauggaaucgagauugauccgaaaaaagguugaagcgauuggaaaauuagaagagccgacaugcaaaagggaugugcagaaauuguuaggaaaaauuaauuacuugaggagguucauaucaaauuuagccggaaagguugaaucguucacaccacuuguucggcuuaaacaugaaucagauuuuagguggggagccaaacaaagagaggcguucacugcuacuaagaaauauuuguugacacc

SEQ ID NO: 7404 - RNA, 131 nt, Zea mays
accggacuguccggugugcaccggacauguccggugcgccaacggcucucaggcugccaacggucgacugcgccauuuauggaaggaaaucgggcaccggacacuguccggugugcaccggacuguccggu

SEQ ID NO: 7405 - RNA, 80 nt, Zea mays
uuugcaaugauucuauuuccugucuuagagaugagaaugcaauuuuacaugcuaagauagaugaauuaaauguuugcaaa

SEQ ID NO: 7406 - RNA, 107 nt, Zea mays
ggugugcaccggacauguccggugcgccaacggcucccggaucugcaacggucgaccgcgccaauuaaggaaaggaaucgggcaccggacacuguccggugugcacc

SEQ ID NO: 7407 - RNA, 205 nt, Zea mays
caggaucagaucgucuuguagccaucuggacucugucgguaacagggauguuugugugagcgagaguuacuucucgcggaagggacgagugagacuuguucgguccacggagucgcuuuaucugagcgugaguuacuuaucgcagaaggugaugagugaggauccgcuuuccgaaguagucaagaagcacgagaguaauccugcu

SEQ ID NO: 7408 - RNA, 63 nt, Zea mays
ucggaccuugcugaagacgucgucgaugccgaggguguugcggcccccuucagcgugaagacc

SEQ ID NO: 7409 - RNA, 254 nt, Zea mays
ccgcuuucugagaggauugguugaucuccuccauuaccagcucaugaaccacacuuuccccaccuuccagcauuugauagacagagcaaucaugaccgaaaggaagcgucggaagauugguggaccucaggccaggaguagcaaucguccccguuacucaggcaacucgccccagcaauucaagcaacaacaacagcagcaguaccgucagaacacucagccgggaggaaaucaguaccagcgucagaacaacc

SEQ ID NO: 7410 - RNA, 97 nt, Zea mays
gaccaaucucggagccaagcugccgaggccgugagccgggcugaggcccuuaggggucagcuggcugaggcuacggagcgguuagccgaggcguccg

SEQ ID NO: 7411 - RNA, 165 nt, Zea mays
aauugcagaggugguaggugauugguacuuugaaagaggagcugacguggagauugacugcgccuaucccugugauucacagucuugucgcaaccuuauaccaauugauaaggcugaccauccuagauuaaacuucaaagaccgguacccugagccauacagaga

SEQ ID NO: 7412 - RNA, 66 nt, Zea mays
agagggugcaaaacaaaucgcaagcaaauaagaggugugacacgcggauuuguuuuaccgagguuc

SEQ ID NO: 7413 - RNA, 108 nt, Zea mays
auuacaagaaggccaagggcgaggcacauaucggaaaggagugggauucggauugcuccuccuccgacucugacaaugaaggacucgcugccacugccuucaacaagu

SEQ ID NO: 7414 - RNA, 71 nt, Zea mays
ggcgaggaccuguggcugcuggagcacgccgaccuguccggcguguuccuggugggcugcagcgccggcgc

SEQ ID NO: 7415 - RNA, 79 nt, Zea mays
uguccaauagaguucuauucuuccucuccacuacaccauuuuguuguggcauguagggagaagagaacucaugcuugau

SEQ ID NO: 7416 - RNA, 167 nt, Zea mays
uaguucaaaugcacauuugcuuuccauuccucuuggcaaaccuccacacuuugauggagaggacuacagauuuuggagucacaaaaugcguagucacuuguucucucuccauccaaguauaugggagauaguagaaaauggaaugcaauuugauagcacggauaguc

SEQ ID NO: 7417 - RNA, 88 nt, Zea mays
auaugauucaaacacaagggcauauagagucuuuaacaaguccucuggacuaguugaaguuucuugugacauuguguuugaugagacu

SEQ ID NO: 7418 - RNA, 100 nt, Zea mays; identical to SEQ ID NO: 6981

SEQ ID NO: 7419 - RNA, 81 nt, Zea mays
uagcauuuaaggguguguuagagggucagcuauacuuaguggauuuuaauagagcugaacucgacacaugcuuaauugcua

SEQ ID NO: 7420 - RNA, 100 nt, Zea mays
auuuccuucgcacucuuuaacccuugcaccuuauuauacuccucucgaguuagagaggcgaggaguauaguaguggcuugggaguuaaaguggugaauuu

SEQ ID NO: 7421 - RNA, 108 nt, Zea mays
acuuguugaaggcaguggcggcgaguccuucauugucggagucggaggaggagcaauccgaaucccacuccuuuccgauaugugccucgcccuuggccuuccuguaau

SEQ ID NO: 7422 - RNA, 239 nt, Zea mays
gacugagagaaccaaccagauucuugaggauauguugagagcuugugcuuugcaagacaaguuagguugggacaagaggcuaccguaugcagaauucuccuacaacaauagcuaucaggccagccugaaaaugucacuguucuaagcacucuaugggaggaauugagaacuccauugcauugggaccaacccggcuaaaggaaugucuucgguccagagauuuugguugaagcugaaga

SEQ ID NO: 7423 - RNA, 73 nt, Zea mays
aagcucccaugccucaagauaacgaggguuacauuuuauacccugccggcuauccugagagcaaaauuaggaa

SEQ ID NO: 7424 - RNA, 98 nt, Zea mays
guuuucgaagauugcgaaaccaaugacagcguugcuaggcaacaagcccuucucgauguauugcgaugcuuguuacacugguuugguaugcguguuga

SEQ ID NO: 7425 - RNA, 244 nt, Zea mays
acuuucauggcuaaguccuucgucauggcaguccggaauaagcucaaggacaugcuggugacuaguuuccaagguuuucagacgaagccagucauagcucaagccuuguuccagugcacgcaagaccaugaggaauaccuccaggcguauguccgaagguucuugcgacugagggcacaagcgcccacagugccgaaugaaauugucauugaggccaugauuaagggucuucggccaggaccca

SEQ ID NO: 7426 - RNA, 342 nt, Zea mays
ugaagaacaggcuccaugcauagcgcuaaggaacauguccauuggggauguguguccuagggaauccgaagagccuccaaaugcacaagaucaaccguccuccuccaugcaagcaucuccaccaacucaaaaugaggaugaagcucaaguugaugaagggcaaaaucaagaagaugagccaccucaagaugauggcaauaauccagggggagaugcaauugaucaagaaaaggaggaugaggaagaaccaaggccgccacacccaagaguccaccaagcaauccaacgagaucaccccguugacaccauccucggcgacauucauaaggggcucuaucaaau

SEQ ID NO: 7427 - RNA, 72 nt, Zea mays
ggcucccaugccucaggauaacgaggguuacauuuuguacccugccggcuauccugagagcaaaauuagaaa

SEQ ID NO: 7428 - RNA, 72 nt, Zea mays
aacucaaaaugaggaugaagcucaaguugaugaaguagaagaucaagcaaaugagccaccucaagaugacgg

SEQ ID NO: 7429 - RNA, 86 nt, Zea mays
uuuucuuccugugcacaccacugauaaggcucaaaaguaugcagaauuguauauugaccggaucguguguuugcacggauuaccuc

SEQ ID NO: 7430 - RNA, 93 nt, Zea mays
ggauaugauucaaacacaaggacauauagagucuuuaacaaguccacuggacaaguugaaguuucuugugacguuguguuugaugaaacuaac

SEQ ID NO: 7431 - RNA, 71 nt, Zea mays
uccgaccgcgugguggacucccccugcugccuggugaccggcgaguacgguuggaccgccaacauggagcg

SEQ ID NO: 7432 - RNA, 126 nt, Zea mays
ccgugcucgcgguuaugagcggccaagggagcuccagagauuagugauacuugaucagagacauugugguacaggugguuaugagauugaugguuccgguuaugacuauggugcuggagaagauga

SEQ ID NO: 7433 - RNA, 133 nt, Zea mays
ugccgcuacgccgccggccgacgccucgucugaggagacgcugaguaguuugauggcggaagaguugcgcgccggcgauucuguggauuuuggcgugucgcggaugucgucgguccgcgugcaagauaugcag

SEQ ID NO: 7434 - RNA, 228 nt, Zea mays
cccuucaccaacauuagaaagaucucugcgcgcauugccgcagccguggcugcaaaagcuuaugaacucgguuuggcgacccgucugccucccccaagggaccuggugaaauaugcacagagcugcauguacacuccugucuaccguaacuaccgauagugcugcugggaucaauucugcaguaauaaaauaugucgacgcagaugauccugcaauguuguaguuuau

SEQ ID NO: 7435 - RNA, 325 nt, Zea mays
cgagccagaugggacgucggucgggcgaggcgaaggcuccuccgaggucgaggcugaguccgagcccuggggucgggcgaggcggacaccgucguccgaggucgagguugaguccgagcccuggggucgggcgaggcggagaccgucguccgaggucgagguugagucugagcccuggggucgggcgauccuugcauugaaugcuccugcgauccggucggcuggcgaggcgaucuuggccaagguugcuucuccgcgaagccugcccgagcugggccucgggcgagucgaagcuuugugcugauagggguuaccagcugagauu

SEQ ID NO: 7436 - RNA, 77 nt, Zea mays; identical to SEQ ID NO: 6722

SEQ ID NO: 7437 - RNA, 254 nt, Zea mays
gacuuauauucaucaugugagaagacauucugccuuuucuaguugcauggauauuggaaguuuggcaguaaagaugguugaaacugaaaagcauaugguuuuuccuuuagucuacaagcuuauugaguugucauuaauacugccaguuucaacaacaacgguugaaagagccuucucugcaaugaaaauaauuaagaacaaacugugcaauaggauuucagaugaaugguucaaucacuugaugguguguuaca

SEQ ID NO: 7438 - RNA, 81 nt, Zea mays
gacccacgcggaccucgugcugccgucccugcgggaaacucucgagaaccugcagauggaguacguggaccuguaccugau

SEQ ID NO: 7439 - RNA, 69 nt, Zea mays
cccgcaggagcuagcuguggucccagucccugcggggggucaggacacacagcucgagcaauuccgcga

SEQ ID NO: 7440 - RNA, 87 nt, Zea mays
uguugagaucccgcgggagcuagcugugguccgagucccugcggggggucaggacacacagcuugagcaacuccgcgagaugcaugc

SEQ ID NO: 7441 - RNA, 81 nt, Zea mays
ggagcuucgacgacaugcccaugucugcugguuucuacugaggcugaggcccagcgacuggugcuuguguacauagggggg

SEQ ID NO: 7442 - RNA, 93 nt, Zea mays
ggauaugacucaaacacaaaggcauauagagucuuuaacaaguccucaggacuuguugaaguuucuugugacguuguguuugacgagacuaac

SEQ ID NO: 7443 - RNA, 78 nt, Zea mays
gcaagauccgggguguaguucgcuucgccgucgugcugucaauggggcucgguguaugcggcucgcuccgccaaggug

SEQ ID NO: 7444 - RNA, 92 nt, Zea mays
cgcuucaaaaccgcgcuuggacgcaaagaguaccccaacaagaacaaaacaaggggaaagcgcuccugcuucaagugcgguaagacugguca

SEQ ID NO: 7445 - RNA, 70 nt, Zea mays
gcugaagacccugagcauauguuuggugaagguugccuuuggugcaaucuaugcucagguaaagaagaag

SEQ ID NO: 7446 - RNA, 62 nt, Zea mays
gucuggacguacauccgggccgucgagcgcuccgggcucgagggcucggaugagucugaguu

SEQ ID NO: 7447 - RNA, 279 nt, Zea mays
acguaugcagaggaggagucgcuccugcgccaggucacggaccgucccagcccugugccgcggaccauccgugccuccacagagagcaccgucaggcgguccuuucuauuguuuggcgcccggaucggugccaacaaguggaucacagauagaaauacacucauugcuuuacugaaagacaacuuggccagggcucagaaccauaugaaacaacaagcugacaguuggaggguggaucauaccuuccaggugggggagcaaguucuauugaagcugcag

SEQ ID NO: 7448 - RNA, 74 nt, Zea mays
caaguucacgaccauguugagugagcauggugcucgaaguuuccgguccgcuccugaaaucggucguaacuugu

SEQ ID NO: 7449 - RNA, 75 nt, Zea mays
ucuugccaaguggcacaagcguuucgaacaccuuaacuucaaggcccugaagcggcucagugccaaggagaugau

SEQ ID NO: 7450 - RNA, 69 nt, Zea mays
ccugcgggagcuagcuguggucccagucccuauggggggucaggacacacagcucgagcaaauccgcgg

SEQ ID NO: 7451 - RNA, 79 nt, Zea mays
gucgggauguucgugcuggugcaggcgcugguguaccucauccugucgcaguccuccaccguguucucgcgcaccaaga

SEQ ID NO: 7452 - RNA, 108 nt, Zea mays; identical to SEQ ID NO: 7201

SEQ ID NO: 7453 - RNA, 90 nt, Zea mays
ccauacucccuccguuucuuuuuauuugucgcuggauaguuuaauuuuguacuauucagcgacaaauaaaacgaaacggagggaguacuu

SEQ ID NO: 7454 - RNA, 52 nt, Zea mays
uuauggauuaucauaaucuagguaucuagauuacauaauucacaguaauaau

SEQ ID NO: 7455 - RNA, 125 nt, Zea mays
cuggguagcgggcucgucggugcugugcagauccacccgcgccccgccuuguucugugcugccgcuuggcgcugcgucacugaccaagugcgugccugccagccgaccgacggccagcaccacau

SEQ ID NO: 7456 - RNA, 174 nt, Zea mays
uuucuaaggaagcauccuaucuugcaucuguuuacucccagguuuaccuugauuuuggcuuggcgauuccaaaacuuaguguucauggaaugacaucgucccugaaagagcuucuggagcuagcucccauaaagaaggucauguucaguacagauggguaugcuuuuccagaga

SEQ ID NO: 7457 - RNA, 82 nt, Zea mays
cggagaagaagacuucuuguauugucucccugacagcaaggagauuucugucugucgggagauaagcaagagcuucggauuc

SEQ ID NO: 7458 - RNA, 82 nt, Zea mays
ggagaagaaggcuucuuguauugucucccugacaacaaggagauuucugucugucgggagaugagcaagagcuucagauucc

SEQ ID NO: 7459 - RNA, 75 nt, Zea mays
agguuuucugaaaugaccaggggcuucggagggagguucuauccgaggcacguuaggucaauucacaauucuacu

SEQ ID NO: 7460 - RNA, 75 nt, Zea mays; identical to SEQ ID NO: 7459

SEQ ID NO: 7461 - RNA, 93 nt, Zea mays
gcccgaggcugggucgggcuuugcugaagacgucgucgaugccgagggugcuacggcucccuucagcaugaagacccgagcccucgccgcgcu

SEQ ID NO: 7462 - RNA, 74 nt, Zea mays
gucgaguugccgaggccaugagccgggcugauguccucgggggacagcuggcugaggcuucggggcagccggcc

SEQ ID NO: 7463 - RNA, 114 nt, Zea mays
ccgcgccaaggcgcggucccagagcgcgccccgccagcgcaccgacgcgcuggagcggcugcccagccgcaggaagcaggggacgccgcccagggccgccgccaggaugcacuu

SEQ ID NO: 7464 - RNA, 94 nt, Zea mays
uuugguugaggagccaaguagaauggagucguuccaucccugauucuaggaacggagucacucuguucuguguuugguaaucuggaacggagcg

SEQ ID NO: 7465 - RNA, 201 nt, Zea mays
cuucuuuuauugaacaucacuccuuuguuucuuguguugagccuacuuguauagaugaggcgcuacaagauccggacugggugaacgucaugcaugaagaacuuaacaacuucacccguaaccaaguuuggacccuagagaagcccccacaagaugcaagaaucauuggaacaaaguggguguucagaaacaaacaagaug

SEQ ID NO: 7466 - RNA, 137 nt, Zea mays
gucccuggcagcgauugcccgggcgugaugaugacgucguccuccagaguggggauccuuggaccgcgucgccguccgaggcuaggucggaccuugcugaaggugucgucgaugccgagggugcugcugcccccuuc

SEQ ID NO: 7467 - RNA, 111 nt, Zea mays
gagcaggccgcgcgaucagcggcggugcuggagccggcgcggagcaucgugcuggccaagguccggguccgccaggccaucagagccgccgggaucccgcacaccuucguc

SEQ ID NO: 7468 - RNA, 73 nt, Zea mays; identical to SEQ ID NO: 6757

SEQ ID NO: 7469 - RNA, 73 nt, Zea mays
acuacaugugcaacuuagggccugaugguaggcgacgugaugcugaugacaggccugaauugucuagaggaac

SEQ ID NO: 7470 - RNA, 107 nt, Zea mays
ggugcacaccggacaguguccggugcccgauuccuuuccuuaaaugacgaagccgaccguugcagaccugggagccguuggcgcaccggacauguccggugcacacc

SEQ ID NO: 7471 - RNA, 85 nt, Zea mays
auuugauuuuuccuguuuccagcacuuagacacaauaaauuaguccauagaacaauguacuaagucugagaaacauaccuuuauc

SEQ ID NO: 7472 - RNA, 205 nt, Zea mays
uauccauuucgagagcgaguccuaccagagcuaccucaaacuucuccaagcucuucuucaugauaacccaucuuugucagaaacuaugaauguggagucacaaauuaugcucgucugugagaaaauacugcgaauguaucugaccugcgcagagcaugaacugucuaaugguguuucugguagggguccagcuuuacaucggaug

SEQ ID NO: 7473 - RNA, 94 nt, Zea mays
cgagcaugguguggugacaaggaacaaagcccgacuuguggccaagggauacucacaagucgaagguuuggauuucggugaaaccuaugcaccc

SEQ ID NO: 7474 - RNA, 78 nt, Zea mays
uaccucccgugcggguucgugggucagccucuccuucagcauucaagggagagggugcuaauuggcccugcgagaggg

SEQ ID NO: 7475 - RNA, 234 nt, Zea mays
uggaggggugggcgcagggcuguccucauguuccuguugcccagacacuugccgucauaccccuaccucuuaggcacaaccgucccuagaaggggcaacagcacuggcggcaucaacuacagcccgaggagcagucuucgagcuucuagccaugguggaauauccgaacaccaugguaaauacuuuuuccucuguguugggcaucaaauugagcggcggacgguccggcccuga

SEQ ID NO: 7476 - RNA, 66 nt, Zea mays
ccagagccguuggcgcaccgaacacuguccgguguacaccggacaguccggugcccccuucugacu

SEQ ID NO: 7477 - RNA, 106 nt, Zea mays
ggaauuaaagauggcuuuguucagccgaagucagcucagucuggaugcaccggacaguguccggugcgccaggcugacucaggcgaacuugcugcucucgggaaau

SEQ ID NO: 7478 - RNA, 101 nt, Zea mays
augagcuagaugaugaagaggcuuccugugucacgcuaaggaacauguccauuggaaauguguguccuaaggaauucgaagagccuccacaagcacaagau

SEQ ID NO: 7479 - RNA, 186 nt, Zea mays
augccgacguggcugucggagagguuuuggugcccuguucaugugaugucgugguugucggaggagugcuugagcccuguggaagcacagcugucggggcugucggagaccgucuuccgaggucgagguggaguccgagcccuggggucgggcgaggcggagaccgucuuccggagucgagguuga

SEQ ID NO: 7480 - RNA, 84 nt, Zea mays
auaaagguauguuucucagacuuaguacauuguuuuagagacuaauauauugugucuaagugcuggaaacaggaaaaaucgaau

SEQ ID NO: 7481 - RNA, 85 nt, Zea mays
gaggaguggucaguguagggagguccuuggguugauuuugcugcgaucgcagucaggcgagggaucccuacauuggagcuuccua

SEQ ID NO: 7482 - RNA, 301 nt, Zea mays
cucacaaugaugcuauggucauaucuugugucaucaagggauuuuugguccauaauguucugguugauacaggcagugcaauggauaucauauuugcuaagguuuucacacagaugcaagaaccagaagacaagauucaugaugcuacacacccucuuuguggcuuuggaggaagacauauugucgcacuugguaaaaucacaaugccagugaccuucggcuucguccacaacacaaggacugaacagguugucuuugacauuguugacauaaaguaccccuauaaugcaaucauugaccg

SEQ ID NO: 7483 - RNA, 369 nt, Zea mays
auacuucuccaagauagaccugaggucugguuaucacaagcugagaaucaaggaagcagauauucaaaagacugcauuugucacccgguacagacaguaugaauucacagugaugccuuucggacugacaaacgcacccgccuuuuucaugaaccucaugaauaagguauuuauggaagagcuggauaaguuuguuguagucuucauugacgacauccuuaucuacuccaagaaccgcgaagaccacaagcgucaccuccggaccauccucggaagacucagggcacaccaacuuuaugcuaagcucagcaaaugugaauucugguuagaaaagauagccuuccuugggcauaucuugacugcagaagg

SEQ ID NO: 7484 - RNA, 155 nt, Zea mays
caaucaccaggugugcugggaccaagucucacacauaugaugaaucauggcacaggaucgaaugucacaucuuuacuauauaauaggaguucuguacaaaauaaauaaacaauuacauuauaaggagacaaugguccagcaacccgaaguugacu

SEQ ID NO: 7485 - RNA, 76 nt, Zea mays
agucugcucagucugggugcaccggacuguccggugaugcaccggacaguguccggugcgccaggcuggcucuggc

SEQ ID NO: 7486 - RNA, 221 nt, Zea mays
cgagagucuugcgagaccaugacaaccacguuugugucacggccgccaccguguaccggagggaacgaggcuugcggcguuuucagccagaagcucgauaguggagacgguggggagcguuugagaggagccggaugcagagcagcacuugcauguggagaaggcacguggcucucuacggaguuacucgaccguggugcuuggcccucgcgugggcuucc

SEQ ID NO: 7487 - RNA, 145 nt, Zea mays
gcgugaugacgucgucgucggaugcgguguccagaacaacccgagagucgucgacguuggcgacaaccaugaggcccccuugcuuaacgauggacaacgcgguacagcuacucuggaccgcguccaagcggcggcuuugcgagag

SEQ ID NO: 7488 - RNA, 72 nt, Zea mays
gacucaaaaugaggaugaagcucaaguugaugaaguagaagaucaagcaaaugagccaccucaagaugaugg

SEQ ID NO: 7489 - RNA, 77 nt, Zea mays
ccgcgaaggucuggacuuauauccgggccgucgagcgcuccgggcucgagggcucggaugagucggaguacuccucg

SEQ ID NO: 7490 - RNA, 91 nt, Zea mays
aagagugcuugaugaucagccauggugguacaaagcauguaauacauguccaaacaaaccauccaugcggucaucagugucaucauguccu

SEQ ID NO: 7491 - RNA, 66 nt, Zea mays
gcggguaggauuuuguacccgugcccguacccaucggguaucgggcggguaucggauacccgcggg

SEQ ID NO: 7492 - RNA, 269 nt, Zea mays
ggccuugcuagauccggauuggguauuggccaugcaggaggaacucaauaacuucaagcgcaaugaaguuuggacacuagugccucgucccaagcaaaauguugugggaaccaaguggguguuccgcaacaaacaggacgagcacgggguggugacgaggaacaaggcucgacuuguggcaaaagguuaugcccaagucacagguuuggacuuucaggagacguuugcuccuguggcuaggcuagaaucaauucguaucuugcuagcau

SEQ ID NO: 7493 - RNA, 139 nt, Zea mays
acuaccaaaaacaaguauccuuugccucguauugauguucuuuuugaucaauuggucggagccaaaguguucuccaagauagaccuucgcuucggcuaucaucagaucaagauacgagcaagugauauuccaaagaccg

SEQ ID NO: 7494 - RNA, 210 nt, Zea mays
cacgcgauggacggaccacgacgucguccggcugaugcuaagguccuuuaccguucuugauccucauuugguaaauaauauucgugagaaucccagguacaccaaaaugucgcccgaagaaguccuuggaaaauucguuagcgggcggaugaugaucaaggaggcgagguacguggacgacgccuugaaugguccgaucaacgaaccaca

SEQ ID NO: 7495 - RNA, 79 nt, Zea mays
gggcuccacugguuaaggacuugaugugccucugugacaacgcauuuaccagagaccagguucugaccaaggaaaaggc

SEQ ID NO: 7496 - RNA, 88 nt, Zea mays
auaugauucaaacacaagggcauauagagucuucaacaaauccacuggauuaguugagguuucuugugacauuguguuugaugagacu

SEQ ID NO: 7497 - RNA, 272 nt, Zea mays
cauugaugacauucugguuuauucucaaagcgaagaaaaacaugcagaucauuugaggaugguauugcagagauugcgagagcaccaguuguaugcaaaguugagcaaaugugaguucuggaucagugaaguccuauucuugggucacauaaucaacaaagaaggauuggcgguggauccgaagaaaguggcagacauucugaacuggaaagcgccaacggaugcucgaggaaucaagagcuucauuggaauggccggauauuaucgucgau

SEQ ID NO: 7498 - RNA, 103 nt, Zea mays
uucuuugaugcucaucgacguuggacuccauucaagcaugauuucaggaguucgcuuacugcauucagaaguggagccaaaaucagaaaugggccaccaaaga

SEQ ID NO: 7499 - RNA, 73 nt, Zea mays
ucaggccccaugagcagaacuacccuacacaugaucuagaauuggcagcuguaguucaugcucuuaagauaug

SEQ ID NO: 7500 - RNA, 495 nt, Zea mays
cauucuucucucgucucguuucauagcgggagcaaacaaagggaacaacagggguaccaacaccuaauccaaagguagaacggacacuaacacggugacagaagcgaaugguaacucgauacuauagauagauaagauaacucggccgaagccaggaugggcccacacaucagucccuccagccgccgccgccgccgccguagccgccaccaccacccucgcgccgaccgccguagccgccaccgccuccguagccgccgccaccacccucgcgccgaccgccguagccgccaccgccgccauaaccgccgucacggcgcccgccaccauagccgccgccgccgcgaccgccgccguagccaccgccgcccucgcgccgaccgccguagccgccaccgccuccuuccaaaugcauauacaccgccacgauuucguaccaccacgaccacccaucucaccgaucuccugcucauggacgccgacgaucccuccgcc

SEQ ID NO: 7501 - RNA, 79 nt, Zea mays
ucuccauccaagcauaugggagaucguagagaauggaaugaaauuugauagcucggauagcccuauguuuauuaaugaa

SEQ ID NO: 7502 - RNA, 83 nt, Zea mays
uggagaagaagacuucuuguauugucucccugacagcaaggagauuuuugucugucgggagaugagcaagagcuucagauucc

SEQ ID NO: 7503 - RNA, 155 nt, Zea mays
cgaucccugagguccucgcucgccggggcuaccgcgcgccuuucccagcaggaugccaagguggcggaccuccagcugcucugcgccgaccugagagccgaggcggcugcagcgcgugcggaggcgcaacggcagcgaucggagcucgcccaggu

SEQ ID NO: 7504 - RNA, 73 nt, Zea mays; identical to SEQ ID NO: 7057

SEQ ID NO: 7505 - RNA, 93 nt, Zea mays
cuaaaacucuugacaaugauuuguuuguaugccaaauuuauguugaugauaucauauuugggucuacuaacgaaucuacuugugaggaauuua

SEQ ID NO: 7506 - RNA, 65 nt, Zea mays
uuucugaaaugaccaggggcuucggaggaagauuucacccgaggcacgucaggucaauucauaau

SEQ ID NO: 7507 - RNA, 76 nt, Zea mays
cagguucucugaaaugaccaggggcuucggaggaagauuucacccgaggcacguuaggucaauucacaacucugcu

SEQ ID NO: 7508 - RNA, 201 nt, Zea mays
guagauuuaggccccguuucaaucucaugggaucgauaaacuuuagcuuccugcuaaacuuuagcuauaugaauugaagugcuaaaguuuaguuucaauuaucaccauuagcucucauguuuagauuauaaauggcuaaaaguagcuaaaaaauagcugcuaaaguuuaucucgcgagauuggaacagggccuuaguuugu

SEQ ID NO: 7509 - RNA, 65 nt, Zea mays
ugguugcuaagacuaacuuggguuggcucuggcaccgccgacuagcccauguugggaugaagaau

SEQ ID NO: 7510 - RNA, 81 nt, Zea mays
uaccucccgcgcggguucgugggucagccucuccuucagcauucaagggagagggcgcucacuggcccugcgagcggggcg

SEQ ID NO: 7511 - RNA, 81 nt, Zea mays
uaccuccugcgcggguucgugggucagccucuccuucagcauucaagggagagggcgcucacuggccaugcgagcggggca

SEQ ID NO: 7512 - RNA, 95 nt, Zea mays
gucgcgccgcgcgcacgggaggaccgcccaagacgucgcgcgcugcuagggcggcguucguguucuggggcuguccugccuuugcuccgguaugg

SEQ ID NO: 7513 - RNA, 72 nt, Zea mays
ggagccaccaggagguguaccacccgggcgcccucaaggcggcguucgcugaguucaucuccacccucaucu

SEQ ID NO: 7514 - RNA, 75 nt, Zea mays; identical to SEQ ID NO: 7059

SEQ ID NO: 7515 - RNA, 62 nt, Zea mays
gucuggacguacauccgggccgucgagcgcuccgggcucgaaggcucggaugaguuggagua

SEQ ID NO: 7516 - RNA, 167 nt, Zea mays
aaagcacauagacaucuggcaucacuuuuugagagaucaccagcaaaagggggauaucgagguguuccauguuagcuccgagaaccagcuagccaauaucuuuaccaagccucuagaugagaagaccuuuugcagguugcguagugagcuaaaugucuuagauucgc

SEQ ID NO: 7517 - RNA, 156 nt, Zea mays
gccguugcaccaccggaugcgcuacuccucuacauacaucguguucaaggacacucauacaacgucagcaacggccaucgucucagcgcacaagaauucauggccagucaguagcgacuuacguggcagguugggcuucagguggacaaugagcug

SEQ ID NO: 7518 - RNA, 78 nt, Zea mays
uugcaauuaagcaugugucgaguucagcucuaucaaaaucuaccaaguauagcugacccucuaacacaccuuuaaaug

SEQ ID NO: 7519 - RNA, 92 nt, Zea mays
gguuaugacucaaacacaagggcguauagagucuucaacaaauccacuggauuaguugagguuucuugugacauuguguuugaugagacuaa

SEQ ID NO: 7520 - RNA, 262 nt, Zea mays
gcgagucgcccagaacccgucgccccgcaggcuccccgcauggacagaggcagaguuggcucgaaaaagaagacuuggucggccggagccuggccgggucguccguuagcgggaccgacgccggaauugaucugccgaggccucgggccaggcugauguccucggaggacagcuggccgaggccucggggugaccagacgagccaccugcucgggccggauucucggagaagacccuggcggcgauggcccgggcgugguga

SEQ ID NO: 7521 - RNA, 81 nt, Zea mays
auggccggagucggucgguccacgcgcgcaggcggggaugcucgucggcggcgaggagaccggccuggucacggcgagaua

SEQ ID NO: 7522 - RNA, 70 nt, Zea mays; identical to SEQ ID NO: 7047

SEQ ID NO: 7523 - RNA, 81 nt, Zea mays
uuugggagaugaaggugucguccuugaguugcuucacuuggaacccaaggaaguaguucaacucgcccaucaucgacaucu

SEQ ID NO: 7524 - RNA, 147 nt, Zea mays; identical to SEQ ID NO: 6865

SEQ ID NO: 7525 - RNA, 91 nt, Zea mays
uccuauggugccugaggcugggccugacugccugucagccucacucugucgaguggcacagcagucggugcggcgcaggcggcgcuguccu

SEQ ID NO: 7526 - RNA, 159 nt, Zea mays
gucuuccaucucucggccuucuggaacgugauacuggcggaaguugucuuugaacuccucccaggugauagcuucaugguuggcauggguggcgagcucccgcucuacugugcgcagcuagucuucggcguccauggggucugcagagugggcaaacau

SEQ ID NO: 7527 - RNA, 81 nt, Zea mays; identical to SEQ ID NO: 7387

SEQ ID NO: 7528 - RNA, 223 nt, Zea mays
uccucggcaacaagucggacuaccucccgcccauccucaccacauaggcugcaggcugcaggcagcgccauggcuucucuccugucuggccucagcuuggugccccucuguuuguguuugagauacugaaaguucagauagcaguguuuuuauuauaguuauugagugauaauaagugcauugugcauggugggacgauaggaguuagaguuguucauaacua

SEQ ID NO: 7529 - RNA, 58 nt, Zea mays
aucccgagguucggccaagccugaaaugcuugccuaguccucguuggaguuagccaca

SEQ ID NO: 7530 - RNA, 255 nt, Zea mays
cgcuuccagaugcccaggucuucgucguguccuucuccggcaacgaacaguggagacaaucaauagaaaaucuugagaucuuuuugguggauaauuuacauggguauuguuaugagucaucgcaacgcacaguucuugcguucgagcaguucgucgaugaacgaagggagaggaggaacggcgucgagcagggaguggucaacggcgaggcacggaugguccaggacgcgaccgaggcgagggcacacagccgag

SEQ ID NO: 7531 - RNA, 183 nt, Zea mays
ccucauccccuacggaugguaccugugcuccaaacucaacaacauuccauauacuuuuguggagugagguuagaugaaauuucauuaaaucacuccaccuagcauaaucuucaccgucaaagguuggcgguuugccuaauggaacggaaaguaauggaguaugucuagauguacgaggauagu

SEQ ID NO: 7532 - RNA, 72 nt, Zea mays
aacacaaaaugaggaugaagcucaaguugaugaaguagaagaucaagcaaaugagccaccucaagauaauag

SEQ ID NO: 7533 - RNA, 93 nt, Zea mays; identical to SEQ ID NO: 7505

SEQ ID NO: 7534 - RNA, 93 nt, Zea mays
cuaaaacucuugacaaugauuuguuuguaugccaaauuuauguugaugauaucauauuugggucuacuaacgagucuacuugugaagaauuua

SEQ ID NO: 7535 - RNA, 131 nt, Zea mays
ccguuacuccacuggcacaccggacaguccggugaauuauagcggagcggcucccagaauuuccgaagguggcaaguucggagucggguucccuggugcaccggacaguccggugcgccagaccagaggug

SEQ ID NO: 7536 - RNA, 100 nt, Zea mays
aaugggucgcgugcucauguucuugguguugguacggucauucugaaguuuacuucgggaaacacggugccauugaagagcgugcagcaugugcccucua

SEQ ID NO: 7537 - RNA, 100 nt, Zea mays; identical to SEQ ID NO: 6981

SEQ ID NO: 7538 - RNA, 100 nt, Zea mays
aaugggucgcgugcucauguucuugguguugguacagucauucugaaguuuacuucgagaaagacggugccauugaagaacgugcagcaugugcccucua

SEQ ID NO: 7539 - RNA, 262 nt, Zea mays
ugcgugcaaauuccugggacucgacaagcugggcagagcagagagccaaccccguguugcaucaacagcagcgcgacucuagugagacccgaguccguaugggccgacagcauggacgagcagacacgacacgaagggugcgaguccgccaaggaugcgaacuugaaggauggcgcaguuuagaacgaaaccuuacugagcgaagaacgacgaccgacaaggcgaagcucgaugacgaggucgagccagggauggccagcgc

SEQ ID NO: 7540 - RNA, 71 nt, Zea mays
gccgguuccucgccgccggccgccgccucgucggaggagacgcugaguaguuuggcggcagaggaauugcg

SEQ ID NO: 7541 - RNA, 108 nt, Zea mays
uuucaaaagcaucaguugaaagagccuucucugcaaugaaaauaauuaagaacaaacugcgcaacaggauuucagaugaaugguucaaucacuugaugguuccacaac

SEQ ID NO: 7542 - RNA, 104 nt, Zea mays
cgagcccuggggucgggcgaggcggaguccaucguccggcgucgagguugagcccgagcucuggggucgggcgaggcagagcuuccuauggcgcccgaggcugg

SEQ ID NO: 7543 - RNA, 62 nt, Zea mays
gucuggaccuacauccgggccgucgagcgcuccgggcucgaaggcucggaugagucggagua

SEQ ID NO: 7544 - RNA, 83 nt, Zea mays
uggagaagaagacuucuuguauugucucccugacagcaaggagauuucugucugucgggagaugagcaagagcuucggauucc

SEQ ID NO: 7545 - RNA, 83 nt, Zea mays
uggagaagaagacuuuuuguauugucucccugacagcaaagagauuucugucugucgggagaugagcaagagcuucggauucc

SEQ ID NO: 7546 - RNA, 85 nt, Zea mays
ucgcggagagcgccgccgaaccgccucugguggacagcuaccuggagcugcuccggcgcggcggcggcggcggcggcauugcggc

SEQ ID NO: 7547 - RNA, 66 nt, Zea mays
acuuaccuggacggggucgacgagccgucaagauggcccguggccuaggucaguggcccuuauugc

SEQ ID NO: 7548 - RNA, 68 nt, Zea mays
ucccgccuccucgacaccacccggcgcgcgcugucgggcgcccgccccugguccgagcucgcggaccg

SEQ ID NO: 7549 - RNA, 231 nt, Zea mays
ucaagccaacuccgccucuguucgugcugauaucgcuaccccuggccucggcucgucgaagagcagccaaggggucucuuuaacuaagcuagaggagccucagacaacaaggccgaucgagccgagggacucccacgccuccgggauacagauaccucacucgucaccuugacacggggcgacucaugcuuggugaagcgguucagauaaucaacaggcgagucuuagugc

SEQ ID NO: 7550 - RNA, 109 nt, Zea mays
cgaaaaugaagauugagauugcacgcuauguggcaagaugugacacauguagacgugucaaggcagugcacaugaagaccgcuggaccauugcaaucuuuaccuauccc

SEQ ID NO: 7551 - RNA, 179 nt, Zea mays
ucaccgaggcgcgggaccuguucgacgcaaugccuaccaggaacgccgccaccuggagcugcaugaucaguggccucgugcugucgggacgcugcugggaggcgcugcaugaucaggggcucuucggugacaugguccgcagcagcagcaucgugccgaaugagcccgcgcuggugagc

SEQ ID NO: 7552 - RNA, 259 nt, Zea mays
ccggaagcaugcccuuuaugugaucaagagcaagaaacaguucagcaucuguugacugguugugucuucgccaggcaguuuuggcauagcauccucucccccuuugguaugggccacuuaacuccaggaccagaagauacuaauuuugcugauugguggggacuagugaccauucaggugcacagaagcaagagaaagggagucaacagugccauuauuuugggagcauggugccuuugguugcauagaaacagaguua

SEQ ID NO: 7553 - RNA, 237 nt, Zea mays
gggaggcagcaagcuugaggcaacaacugcacaacuugcaagaaagccacaaguaugaucuugcaauggauucuaagauaaugugagaaacucuuuuccaauguuguaggcaacuaaugggagaggagcuuucaggccuagguguaagagaccuccaaaguuuagagaaucagauuggaaugagcuugugacuuucuugcaaguaaugcaguuccugccucaugcuuggugccacca

SEQ ID NO: 7554 - RNA, 174 nt, Zea mays
ucuucagcgugcuacaacgacacgaguaugucgguucagacacauacccguggagacuuggcuaccggcucagagagacccugcugcaguugaucucuucagcaccaggauucaggagucuuucuucagagcacagaugucugcacagauugcucugcgagugcaccggcuuuu

SEQ ID NO: 7555 - RNA, 64 nt, Zea mays
uguauaucucuugcacgacucacgugguaagcaccguguugguagucgagcgagcagaagaagg

SEQ ID NO: 7556 - RNA, 65 nt, Zea mays
cccacaauaugauccgagcaccgagcagaucgaccccgaugugcucaugagggucggagcacgca

SEQ ID NO: 7557 - RNA, 88 nt, Zea mays
uagcacccucaugagcacaucggggucgaucggcucggugcucggaucauaguuugggccauggaccuccugcgccauggcgguguag

SEQ ID NO: 7558 - RNA, 77 nt, Zea mays
ucggcuguagagcgagucgacggcuccggcgccccagcgggggacaugucgggcgucgaccucgcgucugagacgaa

SEQ ID NO: 7559 - RNA, 335 nt, Zea mays
ucaagaaguuuggcauggaaaaggcaaagcacgccaagacuccaaugucaucaaauggauaucuugaccuaaaugaggaagcuaauccuaaagauugucaucuuguugccguuaagagaauccuaagauacuuaguccacacccaaaacauaggauuaugguauccuaaaggcucccuuuucgauuuacuuggcuacucugacucaaacuaugccgguugcaaaguagaucaaaaaagcacuauugggacuugccaauuccuugggcgguccuuagugucauggaguuccaagaaacaaaauuguguugcacuuuccacugcagaagcugaguac

SEQ ID NO: 7560 - RNA, 69 nt, Zea mays
gaaugccgugguggcucugucgaaguaugucugggugacgacuucguacggcggacagccaucggucga

SEQ ID NO: 7561 - RNA, 100 nt, Zea mays
gcgaagggugccggcacuucgaggucuucgaccaagccgaugaagauuucgagcgagauaucuuuaagguugaggaccccguagugaaggaguccgccgg

SEQ ID NO: 7562 - RNA, 74 nt, Zea mays
gcauggcaguggcacgagcacuucgggcaucuuaacuucgaggcccugaagcggcucagugccaaggagaugag

SEQ ID NO: 7563 - RNA, 67 nt, Zea mays
ugauaggaagagcacaucaaggacuugucaguuucugggaagaucccuggugucuuggaguucaaag

SEQ ID NO: 7564 - RNA, 79 nt, Zea mays
  misc_feature (62)..(62): n is a, c, g, or u
  misc_feature (65)..(65): n is a, c, g, or u
gguucgugggugagcggaucgagauggcggcgucggauguugaguaccgcugcuucgucggnggncucgccugggaacg

SEQ ID NO: 7565 - RNA, 73 nt, Zea mays
gacgcuagccuggcgcaccggacacuguccggugcaccaccggacaguccggugcacccagaccgagcaccuu

SEQ ID NO: 7566 - RNA, 142 nt, Zea mays
uucgacuggcgacaugaaccgguggaucccucggugguguacgcaaguggugguggaaaagcacauggacguaaucauaauuuuuuuaaucacuuauagauacacacucuucgacggauucauugacucgucgucgggauug

SEQ ID NO: 7567 - RNA, 108 nt, Zea mays
acuuguugaaggcaguggcggcgaguccuucauugucggagucgaaggaggagcaauccgaaucccacuccuuuccgauaugugccucgcccuuggccuucuuguaau

SEQ ID NO: 7568 - RNA, 234 nt, Zea mays
agcuguggugugugauuaagaucgggucucugagggacucuucagaaccgucgugcuguucucauugcugaaguuguuugggccugaugccacgucucugguagcuacaugcuuuuacccgagaugcuaugaucaggccgauacaaauuuguuucgcauguugauaggaaccuggggacggcuucuccaucugucccacagagccgguuucugugaucacauucauucaucaau

SEQ ID NO: 7569 - RNA, 71 nt, Zea mays; identical to SEQ ID NO: 7208

SEQ ID NO: 7570 - RNA, 166 nt, Zea mays
gucuccuggucugugucccacacuccuauccuucucgccuucgacugcccagagcgccccagcgcccgcgacgcuucuagaacacgcgacgcgggcgagcgcgcuggcgggugggcgaggcaaaacuaaggaggcgggaggggcggcgaugcggggcaggugacgc

SEQ ID NO: 7571 - RNA, 80 nt, Zea mays
agggcgugccacacgcgcgcgcgccgccgccgccgccgggcguggcguggcaggcgagcgggcguggugugguuuuugcc

SEQ ID NO: 7572 - RNA, 237 nt, Zea mays
cugaggccgaggcccaaggucgggcgaggcggagcuuccuguggcgccugaggcuggacucagcugcugucagccucaucuuggcagguggcacagcagucggagcgaggcaggcggcgcuacuuuccugucaggcgaucuuugcauugaaugcuccugcgauaccgucgguuggcgaggcgaucuggccaagguugcuucacugcgaagccugcccgagcugggccucgggcgagu

SEQ ID NO: 7573 - RNA, 66 nt, Zea mays
cucucucucucacgccugcguggguugcagaauaaauguguggccuuguauuugugaugaggaaau

SEQ ID NO: 7574 - RNA, 91 nt, Zea mays; identical to SEQ ID NO: 7329

SEQ ID NO: 7575 - RNA, 72 nt, Zea mays; identical to SEQ ID NO: 7488

SEQ ID NO: 7576 - RNA, 72 nt, Zea mays
gacucaaauugaggaugaagcucaaguugaugaaguagaagaucaagcaaaugagccaccucaagaugaugg

SEQ ID NO: 7577 - RNA, 163 nt, Zea mays
guugagcaaccucccggcuuugaagacagugaguauccuaaccauguuuauaggcucucuaaggcgcuuuaugggcucaagcaagccccaagagcaugguaugaaugccuaagagauuuccuuauugcuaauggcuucaaagucggcaaggccgauccuacac

SEQ ID NO: 7578 - RNA, 88 nt, Zea mays
aguuuacuacuguucuuguuuauuugucgcgguuuaguuuaaaaauguacuagcugacgacaaauauucgagaacggagguaguacuu

SEQ ID NO: 7579 - RNA, 78 nt, Zea mays
gcgccccuggcgaggccugacugccugucagacucacucugucgaguggcacugcagucggaguggcgcaggcggcgc

SEQ ID NO: 7580 - RNA, 79 nt, Zea mays
ucuccauccaagcauaugggagauuguagagaauggaauaaaauuugauagcucggauagcccuauguuuaucaaugaa

SEQ ID NO: 7581 - RNA, 130 nt, Zea mays
cugucugguugcaccggagggucucacaacacgucguacgccgcgagggcgguacucguguucugggacggucccguucuaguuuucguggcgaggacgggagugaggaccugccggugcgcuuuggggc

SEQ ID NO: 7582 - RNA, 252 nt, Zea mays
uuggggcggccggcgcccgcuggugcgguguuggugggcagguggacgccaccgccggugccgaggugguggcaguuggagaaagcuucuccgcugacgagaccgucagcgccacccgcgggccgaccuccggcucuuuggcuuuaaugucugguucucgucccucgaguggggacacgaacgagagccuuccagcgguagcguccgcccugggaccaucgcugcugcugcagaggucgccggcgagucacc

SEQ ID NO: 7583 - RNA, 65 nt, Zea mays
ucucguggaggacuugcagggcguuagccucguaccugagauaacggugcaguccguccccgacg

SEQ ID NO: 7584 - RNA, 72 nt, Zea mays; identical to SEQ ID NO: 6882

SEQ ID NO: 7585 - RNA, 362 nt, Zea mays
gccaguaccacgccuucucgacugcggaaccggugccgcgacucgaggcaacccugcgcucagcccaacagugccaaccaagcgcaucggucacgggucagucagccgcgggagaaggcgcgacggucgauauggccagaagugggccggcaguaaugacggcggcaggcgggcggaagcagcagucaaaucgccugcaggcucacguccccucccggagcagcaggagagcucucucccacggcgugaagacgacgugcccguguuccgucccaugaacggcucgcgcacgcacaacggcugccccgcaaaccacucgucccgucgcauuaacuccgcagcaaggcaggcgacaccuuugg

SEQ ID NO: 7586 - RNA, 92 nt, Zea mays
uacauguaagcagccaaggccgaccgagccgagggacuccuacgccuccgggauacggauaccucacucaucaccuucugugauaaguaacu

SEQ ID NO: 7587 - RNA, 84 nt, Zea mays
cggcgaagugacggcggucacuucggcucugccggggggcaaggccucgggcgagccggagauguguccgccguuggagggggg

SEQ ID NO: 7588 - RNA, 69 nt, Zea mays
ccugcgggagcuagcuguggucccagucccugcggggggucaggacacacagcucgagcaaauucgcga

SEQ ID NO: 7589 - RNA, 225 nt, Zea mays
augaucuacggugggcaaguggcgaaugccucggcucagcaccgcaagcaggagcgcugggaggucugcucgguaaagguggcggugccagucuaccuagacugguccgacaagcccaucaccuucgaccaaggcgaccaccccgacugcgugccgagcccaggaagguacccgcucauugucaaccccgucaucggcaacgccaggcucaccaauguccucaug

SEQ ID NO: 7590 - RNA, 128 nt, Zea mays
gucugucuuccguggccgaggucgaguccgagcccccgggucgggcgaggcggagaccgucagcugaggccagggcugaguccgagcccuggggggcugagcccgaguccgagcccugggucaggcga

SEQ ID NO: 7591 - RNA, 69 nt, Zea mays
ccugcgggagcuagcugugguccuagucccuacggggggucaggacacacagcucgagcaaauccgcga

SEQ ID NO: 7592 - RNA, 88 nt, Zea mays
acacuacuucgagucucauccggugacuguggugucauccuucccccugggggagaucauccagugccgagaggccucggguaggauu

SEQ ID NO: 7593 - RNA, 115 nt, Zea mays
auaaguuaucuggaaaauccuguugaguugcucaaugaagcggcaaaagcugcagagaaagaucuauggaaaauccuguugaguugcucaaugaaggcuuuugcgaaucacuuga

SEQ ID NO: 7594 - RNA, 80 nt, Zea mays
ccggagaagcccucuugaucuacgucgccgcgaccacucaggugguuagcgcugugaucgugguugagagacgagaagaa

SEQ ID NO: 7595 - RNA, 84 nt, Zea mays
cgagccagaugggacgccggucuuguuuccugcggcccgaguuagcucgggguagggcgaugauggcgccuccugucgacgugg

SEQ ID NO: 7596 - RNA, 88 nt, Zea mays
acacuacuucgagucucauccggugacuguggugucauccuucccccuacgggagaucauccagugcugagaggccucggguagaauu

SEQ ID NO: 7597 - RNA, 100 nt, Zea mays
ggaugggaaucggucgguaccuuuuggucgacgaggagcgucauagucgcgucggggacugauugcaccgucgucucagguacgagggcgacguccugca

SEQ ID NO: 7598 - RNA, 110 nt, Zea mays
gcugcauggugaucgcaagcccccgaguguauuucuugcaacagcuccuguccuucggcgacggauaugcaucguuggagaaugccugaggggcugcggugguagagcuc

SEQ ID NO: 7599 - RNA, 168 nt, Zea mays
gcaagcgguggaugaaggaacuccccucgguggucuggagucugaggacaacgccgagccgagccacgggcuucacaccguucuuucuagucuauggggccgaagccaucuugcccacagacuuagaauacgguuccccgaggacgagggccuacaccgaccaaaaca

SEQ ID NO: 7600 - RNA, 88 nt, Zea mays; identical to SEQ ID NO: 7592

SEQ ID NO: 7601 - RNA, 114 nt, Zea mays
uguguggggggcccguuacggugggccggaucgcacgugggccucugagcuggacgaggccacacugugggaugacgucgucgccggucuucgucuggugccgaucaagcgaag

SEQ ID NO: 7602 - RNA, 88 nt, Zea mays
gugucagaucguggaccucaauuuguagccaaguuuugggaagcacuucacaaauccuuggguacuaaguugcuccauaguucggccu

SEQ ID NO: 7603 - RNA, 283 nt, Zea mays
ugccuucauggugugccgaagaagauagugucagaucgaggaacacaguucaccucucauuuuuggcagcagcuacaagaagcuuugggcacgcauuugaacuucagcucggcuuaucacccgcagacagaaggucagacugaaagaacuaaucaaauucuagaagauauguugagagccugugcguugcaagacaagucaggaugggacaaaagaaggagaagagaacugaguuuugaagugggagauuacgucuaucugaaggugucgccuaucagaggag

SEQ ID NO: 7604 - RNA, 79 nt, Zea mays; identical to SEQ ID NO: 6868

SEQ ID NO: 7605 - RNA, 87 nt, Zea mays
gguugaguccgagcccuggggucgggugaggcggagaccgucuucugaggucgagguugaguccgagcccuggggucgggcgaagcg

SEQ ID NO: 7606 - RNA, 70 nt, Zea mays
caucccccuggcgcaggauaacacgagccguguuuucuccccuuguguuccaucucgcgccaacucaucu

SEQ ID NO: 7607 - RNA, 205 nt, Zea mays
cggcaccacuugucgggaccuggugagcaaacuggggcgcaagacucccacccgcgcgagcgaacuaauggacgucgccaccaaguucgccucgggucaagaggcgcacaggaacccucauaaaccaccuggagggcccggcgcguucgacaagaugcucaaagagucgugccccuaucaccaggggcccgucaaacacacccuc

SEQ ID NO: 7608 - RNA, 64 nt, Zea mays
auggguuggcgcgagauggaacacaagggagaaacgcggcucguguuaucucgcaccagggggg

SEQ ID NO: 7609 - RNA, 63 nt, Zea mays
gggagcaccacgagggacggcggccgcggcgacaucgcggcuuagccgaccuuaucgcuucgc

SEQ ID NO: 7610 - RNA, 96 nt, Zea mays
gcagcagcggcggcuggagcuuggccaggucguccgccggcgagaccaaccccggagucgggcugccgaggccaugagccgggcugauguccucgg

SEQ ID NO: 7611 - RNA, 265 nt, Zea mays
cccugaggucaucgcugcugcuguuuagccacccggaguggaggucguugucgcugcugauggagcggucaccgcugaaccgcuuaccaugugugaguugcccuaugcggaaggugacgagugagguauccguaucccggaggcguaugagucccucggcucggucggccuugccacccaaggcuucucuugcucgguuaaagaacccucggcugcucugcgaugagccagagccggaggcagcggugucagcguggacagaggc

SEQ ID NO: 7612 - RNA, 226 nt, Zea mays
guaccauugagcgcaccaggagcuucgcagcaagguucggcgaggucacgcaugugaggugcuguccagcauugagcagaaauaaugcagaauacuugcgggaugagccauugacggcugcuucgcugauuaaaacaccuccgugaacacaaacaugaggcgcagaaaaaaaaaaaaaaaauaacuggauuugcauagcuguaacaguuuuggugccuugaacugu

SEQ ID NO: 7613 - RNA, 163 nt, Zea mays
guugagcaaccucccggcuuugaagacagugaguauccuaaucaugucuauaggcucucuaaggcgcuuuaugggcucaagcaagccccaagagcaugguaugaaugccuuagagauuuccuuauugcuaauggcuucaaagucggcaaggccgauccuacac

SEQ ID NO: 7614 - RNA, 183 nt, Zea mays
caggccaagagcggaccguccgggcccuugcggcggaccguccgcgacacaaggaugucucucggacagaaccaaugcaaaaauacaaguuuccacuacggacuguccggaggaaaagcuaagaccguccgagcccucgcgcggaccguccggccucaggcgcggaccguccggucggcgacu

SEQ ID NO: 7615 - RNA, 70 nt, Zea mays
ugugaguuuugagugcaugaucgaaggcucgaggaagaucaacgagcuugaugaugccaccacauccgaa

SEQ ID NO: 7616 - RNA, 70 nt, Zea mays
uguaaguuuugagugcaugaucgaaggcucgaggaagaucaacgagcuugaugaugccaccacauccgaa

SEQ ID NO: 7617 - RNA, 62 nt, Zea mays
gucuggacguacauccgggccgucgagcgcuccgggcucgagggcucggaugagucagagua

SEQ ID NO: 7618 - RNA, 62 nt, Zea mays
gucuggacuuacauccgggccgucgagcgcuccgggcucgcgggcucggaugagucggagua

SEQ ID NO: 7619 - RNA, 397 nt, Zea mays
uauugcacgagggagaauccacuugccuugcccaauaccauccugcgagacucucaugcuccguauaugaguccucuaccacucugacucauucuauuagcgucgcuucuacuacauucaacagcuagcauucaccuauuuuaaucguaggccaugacgugcgugacguacucaugcguaguugaccgaguacucgcuggcuauucgcauuagagccaggcacuggaagcaugcucugcaucguaccgacuaauacuagccauaucacuaucgaugaguuccccagccgacgaaugugguuucauuaccuaaggaauaccuucgaagggauucccacccugaugcugaauaaaaaaaagucgcuaagggccgugguggaauuuacccgacucuaaga

SEQ ID NO: 7620 - RNA, 262 nt, Zea mays
ccgaacgcuggccuguucuucccugccuuuggcccauucgucaggcggccccuccgcaggcgacgcaggcgcgggcacgacggcgcguggccccgacuacguagacagcuaaccggucuccgccuccggcccuucuccugucgcccgauugagucgcugcugcaacugccaacuucacccccggcgagcucaccacagucuuccggaaaggugcuaucaauuuggaagauggcagaugaggagcaggccccaagcucuagga

SEQ ID NO: 7621 - RNA, 69 nt, Zea mays
uugugaauauauacaacuguaaggguacuacccaaggggugugucccuugggguugaauugaucacaac

SEQ ID NO: 7622 - RNA, 79 nt, Zea mays
aggcgaacgacgcguuccucggacgugcucacgcggagaucgaggcagugaaggcggccggggagcgcgcgcugcagcg

SEQ ID NO: 7623 - RNA, 55 nt, Zea mays
cucggaucggagcuucucugcgugucgcagccaagcuuccuuccccauggcgccc

SEQ ID NO: 7624 - RNA, 78 nt, Zea mays
uguccgugccugaucucgagacagucccguuucgcguacugaagcgcgaggcagaguacgagaucagagaaguggagu

SEQ ID NO: 7625 - RNA, 167 nt, Zea mays
cgucaacuucguccuccccuacaaguccgagaucgccaacaaggagguggacaugguaauuguaccagcuacaacuggucagaugggcguuuugccaggccauguugccacgauugcagagcucaagccugguguucucucaguacaugaggggaacgaugugacca

SEQ ID NO: 7626 - RNA, 84 nt, Zea mays; identical to SEQ ID NO: 6851

SEQ ID NO: 7627 - RNA, 100 nt, Zea mays
cucucaaaaagugaugccggaugucuaugugcuuugugcggcuguguucaacaggauuuuccgccaugcggauagcacucucauuaucacauaggagugg

SEQ ID NO: 7628 - RNA, 275 nt, Zea mays
cccccgccaacccgcgcgacgagcaccagcacugguacaaggacaugcgcuucagcacccaggucaaggacgaggagggcaacccugcguucgcccucgucaacaaggccacugggcucgccaucaagcacucccucggccagucccacccgguaccuguuuguacuccuguucuucuauccaucggccaggacgagggagggcuugauuucauuuugguucuuguauccauuuguucaggugaagcuggugccguucaacccggaguaccagga

SEQ ID NO: 7629 - RNA, 66 nt, Zea mays
cuaagccacgugcugaggcuuucguuggucucuucgccggcgacgagcacccagcaguucuguaga

SEQ ID NO: 7630 - RNA, 197 nt, Zea mays
caagaaagaucuagcuaagagguugcugcuugggaagagcgcaucaauagaugcugaaaaaucgaugaucacaaaacucaaaacugaguguggaagucaguuuaccaauaagcuggagggaauguucaaggacauugaauuauccaaagaaauaaacgauucauucaggcaaucaucucaagcuaggacaaagcuuc

SEQ ID NO: 7631 - RNA, 96 nt, Zea mays
cuggaccgguggaccguuucccugauuccuucggugguggcugaagcugaauggugagcugcuggagaguggagacguggagugguggccgguggg

SEQ ID NO: 7632 - RNA, 88 nt, Zea mays; identical to SEQ ID NO: 6734

SEQ ID NO: 7633 - RNA, 171 nt, Zea mays
uccggucguggucgcgccgccgcgggagcaagaaaucaucgucgucgucgucgcugggggcgcuguggcggcggauggucgggccacgcagggggacccggacccggacucggacccgugcccgggggaagaagccggggcugcucucgcgcgccgcgcgggugcucuccu

SEQ ID NO: 7634 - RNA, 105 nt, Zea mays; identical to SEQ ID NO: 7383

SEQ ID NO: 7635 - RNA, 72 nt, Zea mays; identical to SEQ ID NO: 7144

SEQ ID NO: 7636 - RNA, 75 nt, Zea mays
acccacucuggcgcaggauaacacgagccgcgguuucuccccccccuuuguguuccaucucgcgccaacccaucu

SEQ ID NO: 7637 - RNA, 79 nt, Zea mays
gccccucucuuggugaggagcacgaccguaaccguuugaccucccacgguuacuauuguacucgucgccuccaccucuc

SEQ ID NO: 7638 - RNA, 67 nt, Zea mays; identical to SEQ ID NO: 6720

SEQ ID NO: 7639 - RNA, 88 nt, Zea mays
acacuacuucgagucucauccggugacuguggugucauccuucccccugggagagaucauccagugccgagaggccucggguaggauu

SEQ ID NO: 7640 - RNA, 134 nt, Zea mays
acgaggugaugcggaugaucugcgucgugaccgcccacggcggcaaauccggcgucgccauccccaagggcuacuauggcaacgccuuugcguugccagccgccgucgcgacggcaggugaucucgucgccaag

SEQ ID NO: 7641 - RNA, 125 nt, Zea mays; identical to SEQ ID NO: 7045

SEQ ID NO: 7642 - RNA, 90 nt, Zea mays
ccgcguguggcagccuagccgagagucgccggggcucgcuaugucgcgcgcguucggcgacuacugcgucaaggacugcggugucaucuc

SEQ ID NO: 7643 - RNA, 83 nt, Zea mays; identical to SEQ ID NO: 7285

SEQ ID NO: 7644 - RNA, 87 nt, Zea mays
accuaaaaccaucgccuuagccuuugcacaauucaguuuuagaguccgcaguucugaguucguguucuagguuguguuugguugcug

SEQ ID NO: 7645 - RNA, 207 nt, Zea mays
cuuuucuuuugacuacucucguauuccgcaaaguucaaauucacauuugcucuccauuccucucgguaagccuccacacuuugauggggaggacuauggauuuuggagccacaaaaugcguagucaccuauucucucuccauccuaguauaugggagauuguagagaguggaaugcacuuugauaguacggauagucccauguucau

SEQ ID NO: 7646 - RNA, 102 nt, Zea mays
caggcuggagcuuggccagcaccuccggcggaagcuucgacaccacuacuugcgguggaacgacguuggccggcugguuggcguuggcgggcauguuuacug

SEQ ID NO: 7647 - RNA, 257 nt, Zea mays
aagacuaucacccucgagguggagucgucugacaccauugacaacguuaaggccaagauccaggacaaggagggcauccccccagaccagcagcggcucaucuucgcuggcaaacagcuugaggacgggcgcacgcuugcugacuacaacauccagaaggagagcacccuccaccuugugcuccgccucaggggaggcaugcagaucuuugugaaaacccugaccggcaagacuaucacccucgagguggaguccuc

SEQ ID NO: 7648 - RNA, 80 nt, Zea mays
cguccgucucgagguccgucagagccgccgccggcggcgcaaccgagccgccggccgagccugccuccucggcaaaggac

SEQ ID NO: 7649 - RNA, 199 nt, Zea mays
caucgaucaccuucaacuuucaaucauggcggacgucgaugucgaaccggagguugccgccggcgcucccaagaagaggacguuccgcaaguacagcuaccgcggcgucgaccuagaugcgcuucucgacauguccacggacgaccucguccagcucuuccccgcgcgcgccaggagaagguuccagaggggucugaag

SEQ ID NO: 7650 - RNA, 168 nt, Zea mays
gaugcaccagugcacugcagcugcuucgucgucgucuucaccugcuccugcugcuagaggccugcagguugcugcccaucccagucccagcaggaggcggcguccucguggccucguugccgcggccggcagugacgacgacgaaugcgcuucagaugguggugaguc

SEQ ID NO: 7651 - RNA, 65 nt, Zea mays
ccucaucgacgccgccgccgccgccgccgggaccgacggcgacggcgacggcgaggacgaggagg

SEQ ID NO: 7652 - RNA, 157 nt, Zea mays
cugauaacguguugaaucucaguggagagagacagauaaugacaaaugacugaacucauuauugcagggaacauccugauauauauacaggugaaggguugcguucucaagggggugucccuuggaaauaaucugucgcaccccuuggauugaucac

SEQ ID NO: 7653 - RNA, 276 nt, Zea mays
aucaagaacaacugccugaucgguggugacgacuucaagagugggcagaccaagaugaaaucgguccugguugauuuucuuguuggugcuggaauaaagcccaccucgauugugagcuacaaccacuugggaaacaacgacggcaugaaccugucugccccucaaacauucagguccaaggagaucuccaagagcaacgugguggaugacauggucucaagcaaugccauucucuaugggcccggcgagcaucccgaucauguuguugucaucaag

SEQ ID NO: 7654 - RNA, 75 nt, Zea mays; identical to SEQ ID NO: 6756

SEQ ID NO: 7655 - RNA, 220 nt, Zea mays
cugucccuagccggacuucggucuuccgccgccgcguguggaccgagcuauccagugagucuccgcccaauuccuugcgcucauaucuucucuggcaucccguggaccucccugacccaucugauugaacuaucucgccgugaccaggccggucuccucgccgccgacgagcauccccgccugcgcgcguggaccgaccgacuccggccaucucugacgg

SEQ ID NO: 7656 - RNA, 62 nt, Zea mays; identical to SEQ ID NO: 6796

SEQ ID NO: 7657 - RNA, 84 nt, Zea mays
uacgcgggggcaggugaugaugauguuuggacugauacuugaugucucaaaaucgagcuuuuuaaaacugaugcccaguuuauc

SEQ ID NO: 7658 - RNA, 60 nt, Zea mays
cuacgugcuugggugcuacgccgucgcggcagcgagguacgggcacccggaccucgcggc

SEQ ID NO: 7659 - RNA, 186 nt, Zea mays
gcccggauaugaggugugggaacaucauggugagguaguacccaacaggaauguagaagaggaggagaacaaugauugggcuggcgaugaugcgaugcaugagaugcuagauucgcuacguccagaauucaaccuaagcuccgaggauccugccacaccagagguuuccagauuuuuuaaacuacu

SEQ ID NO: 7660 - RNA, 302 nt, Zea mays
agaacuucgagcgguucaaggagucggagguguaccacugccggugggccaugcuggccgugccgggggugcuggugccggaggcgcuggggcugggcaacugggugaaggcgcaggagugggcggccguccccggcgggcaggccacguaccuggggcgccccggugccguggggcacgcugccgaccauccuggcggucgaguucguggccaucgccuucgccgagcaccagcgcaccauggagaaggaccccgagaagaagaaguaccccggcggcgccuucgacccgcucggcuucuc

SEQ ID NO: 7661 - RNA, 100 nt, Zea mays
aaacccacggccuucguguuugucccgcgcccagguuaggugcgcuugcaguaggggguuacaagcguccgcgugggagggagcgagaggccugcacgcg

SEQ ID NO: 7662 - RNA, 145 nt, Zea mays
cuucuccacugagggugaggugauugaugcaagcguuguguaugauccuuggacaagggaaucacggggguuugguuuuguuaccauggcugcuguuaaagaugcagaucgcugcaucaaauaucuggaccguucuguguugcaa

SEQ ID NO: 7663 - RNA, 60 nt, Zea mays
uuguuauaaaauuuuuaucacuuauaugcugcauuaggugauaggaguugagugaugaaa

SEQ ID NO: 7664 - RNA, 82 nt, Zea mays
ggaccccgcgccucuccgcucuccgcgcucaccuccaccguuccgcaacucucgacgcgcaggagccgacggcgaggccugg

SEQ ID NO: 7665 - RNA, 72 nt, Zea mays
aacucaaaaugaggaugaagcucaaguugaugaaguagaagaucaagcaaaugagccaccucaagaugaugg

SEQ ID NO: 7666 - RNA, 68 nt, Zea mays
aagcgcgaccuccacgccucgucgccggcagcuaagcgcagccggagaucgguggagaagcggguugu

SEQ ID NO: 7667 - RNA, 418 nt, Zea mays
ucuugcaacugcggaucaagcugcggcugcggcucaagcugcaagugcggguaauauauacauaauaauauauaagugcaccgugcaugauuaauuucuccagccuucuucuugucuugucuaguuaauuucccuucuucuuuauuuauuuuuuuccauugcaaaacaaacaaacaaacaagaacaaaguuaauuuggaucgaguaguucaauccauuugcgcgcuguccuuuuucagcaagaaguacccugaccuggaggagacgagcaccgccgcgcaggccaccgucguccucggcguggccccggagaagcaggccgcgcccgaguucgucgaggccgcggcggaguccggcgaggccgcccacggcugcagcugcgguagcggcugcaagugcgaccccugcaacugcugauc

SEQ ID NO: 7668 - RNA, 182 nt, Zea mays
cacauauuaaaucaucaccacucauuuuagaucuaacguuucuaguuguuugguauauuuugcuaaaagcacccuccaacguggugguguguagugguggaagccuggaagguguuauuuguaaauugaaugaucaacuaaagacguuagaucuaaaaugaguggugauaauuuaauauaug

SEQ ID NO: 7669 - RNA, 184 nt, Zea mays
gcgaggucgucgacccgucuaucccggcggcagcuucgacccgcucggccucgccgacgaccccgaggccuucgcugagcucaaggugaaggagcucaagaacggccgccucgccauguucuccauguucggauucuucguccaggccaucgucaccgggaagggcccgcucgagaaccucgcu

SEQ ID NO: 7670 - RNA, 222 nt, Zea mays
ucccugcucggauuuggucaagcucacgcgcgauuccuagcucggucucuagcugccugugcgcacaucgaguuauggccguggugauauugugguguggcgacgucgugcguguugcgacagcugucguggcugugaggcagucugcaccauagaguucgcccaaccgcgaucucgauuuacuccucgcgucgucgcuugccgaguccuuccccgguccgu

SEQ ID NO: 7671 - RNA, 74 nt, Zea mays
uguaaguuuugagugcaugaucgaaggcucgaggaagaucaacgagcuugaugauccaucuacauccgaagcuc

SEQ ID NO: 7672 - RNA, 63 nt, Zea mays
uacaggugacgggguucgcgcugcuugagacgaucaaggaggcgcuccccgcugacaugugga

SEQ ID NO: 7673 - RNA, 92 nt, Zea mays
gcggaagaucgccgacggcgccuggaucucgcucccgggagggaccccgucggggaggagagauccuaggaguugucuaggcucgggcaggc

SEQ ID NO: 7674 - RNA, 272 nt, Zea mays
caccaccagacgcccgcgccgcccguggugguggacacgcaugcucaccaccaggagggagagcacuucccggcgccggcgccucccccgcacguggagacgcaccaccccgucgucguccacaagaucgaggacgacgacacgaagauucagaccccaccacaggcaccggaggaggagaagaaaggccugcuggacaagaucaaggagaagcuucccgguggccacaagaagccggaagacgcugcugccgccgccgccgcgccggccgu

SEQ ID NO: 7675 - RNA, 213 nt, Zea mays
ugacgucgcugcuggaggaggucagccgggagaggcgccccgacgccggcgccggggagaucggcgucgauccugagcucgacgaauucauggacgcuuacugccgggugcuggugcgcuacaaggaggagcugacccggccguucgacgaggccgcgucguuccugagcagcauucaggcgcagcucagcgaccucugcagcgguggaagcu

SEQ ID NO: 7676 - RNA, 73 nt, Zea mays
cuccguuucgguuuuaguugucgcuggauagugcaaaauugaacuauccagcgacaacuaaaaagaaacggag

SEQ ID NO: 7677 - RNA, 82 nt, Zea mays
gggcggagcggaguucgucgucuuccggggccuuagcccgaguccgagcccuggaucgggcggagcggaguucgccgucuuc

SEQ ID NO: 7678 - RNA, 263 nt, Zea mays
aggcuuuggccucucuguuguaaguuuuaagcuucaccuccagccauggguaaagagaagucccacaucaacauugugguuauuggccaugucgacucuggcaagucaaccaccacuggccaccugaucuacaagcuuggaggcauugacaagcgugugauugagagguucgagaaggaagccgcugaaaugaacaaacgguccuucaaguacgccugggugcuugacaagcucaaggcugagcgugagagagguaucaccau

SEQ ID NO: 7679 - RNA, 204 nt, Zea mays
uuaggggggguuugaaugcacuagaacuaauaguuaguuagcuaaaaauuauuaguuagauuagcuagcuaacaaauaacuagcuaacuauuaacuacuuuaccaaaaauagcuaauagcuaaacuauuagcuagaguguuuggcacguuucaacuaauuuuagccacuaacuauuaguuuuagugcauucaaacacuuccuua

SEQ ID NO: 7680 - RNA, 76 nt, Zea mays
guguuguguugugugggugcagcacgguagcaggcuagccaugugcccugcuguguugggucaccauccaucuaua

SEQ ID NO: 7681 - RNA, 75 nt, Zea mays
cccuccucuucuugcaggcgcugcugggcuccgugccgcuggugcacguggaggacgucugcgaggcccacgucu

SEQ ID NO: 7682 - RNA, 79 nt, Zea mays
gccaagggcggcgcggugaccccggcgccggccgcggccaugcugggcucgcuggcgggguggcugucccggaccgugc

SEQ ID NO: 7683 - RNA, 76 nt, Zea mays
acaagcgguuuuuguuuaggaccgucuguggugcucuauccuuuucacaaacggacccuaagaaaaaaccgccucu

SEQ ID NO: 7684 - RNA, 170 nt, Zea mays
uacaccugcgcugcaccaccaugagagagagagagagagagagagagagagagagagagagagagagagagugcaaucgaagagaucgaggaagcugaccucgggccggacccagcggcuggccaucugagucggagucucuucgcacugggacgcggccucgacggcgg

SEQ ID NO: 7685 - RNA, 107 nt, Zea mays
aaaucgguuaggaauuauuccgugccuccguuccggauaaaaugaacggcccuuaaagccuuguucguuuccgucggauugcacccggaaucguuccagcuaaucaa

SEQ ID NO: 7686 - RNA, 107 nt, Zea mays
gcggcgcgcgcagccgcgcagcagcaggagcgccaucgggugucuguguggcgcuugccgcacgagacgagagaggcuuggcugcugccgcggcgugcaggugcgac

SEQ ID NO: 7687 - RNA, 180 nt, Zea mays
agcaugaaaagaagggaagguguuuuuucgucaaagacucaaaagcgguacguguaaaguuucaugcaucguaaagaauugacuaacaaagauagguauauuacauuugcgguugcaaaauguuacaguauauuacauuucagaaguuuucacaaaaauauuuaaucuucucucaagacg

SEQ ID NO: 7688 - RNA, 83 nt, Zea mays; identical to SEQ ID NO: 7308

SEQ ID NO: 7689 - RNA, 83 nt, Zea mays
caaaagguauguuucuagacuuaguacauuauuuuauggacuaauguguugugucuaagugcuggaaacaggaaaaaucgaau

SEQ ID NO: 7690 - RNA, 59 nt, Zea mays; identical to SEQ ID NO: 6999

SEQ ID NO: 7691 - RNA, 78 nt, Zea mays
accauggauuuaauccggguauggauugggugaauccauaucucacacccaaucccauggugggauuaaauccaucaa

SEQ ID NO: 7692 - RNA, 421 nt, Zea mays
gcagauccaagcggagaagcugcgucguggccugacccuguccguccucuccggucggcgagagcaagaagagaucccgcgccguccucuucuccaccuccaccuccaccuccacccauggcggccuccaccuucagcggcgacgagacggcgcccuucuucggcuuccucggcgccgccgccgcgcucgucuucuccugcaugggcgccgccuacgggacggccaagagcggcgucggcgucgccuccaugggcgucaugcgccccgagcucgucaugaaguccaucguccccgucgucauggcgggaguacucggcaucuacggccucaucaucgccgucaucaucuccaccgggaucaaccccaaggccaagcccuacuuccucuucgacggcuacgcgcaccucuccuccggacucg

SEQ ID NO: 7693 - RNA, 66 nt, Zea mays; identical to SEQ ID NO: 7023

SEQ ID NO: 7694 - RNA, 219 nt, Zea mays
gcuagugacgguugcucuagauccguucauccuggugguuuugugaggucgaaagcggcgagcgaauuagaagaugcuggacaagcugugggacgacgugguggccgggccucgcccggagacgggccucgagaagcuccgcaaggccaccaccgcccgcccgcucgucaucaacaaaggcucuacagcgacgagaccaggagcaaccaccgcuagauc

SEQ ID NO: 7695 - RNA, 72 nt, Zea mays
caugggcgggggccuccuggcagcagcauccgcccugaggucagugcugccgcuguucggccccccggagca

SEQ ID NO: 7696 - RNA, 73 nt, Zea mays
uguaaguuuugagugcaugaucgaaggcucgaggaagaucaacgagcuugaugauccauccacauccgaagcu

SEQ ID NO: 7697 - RNA, 66 nt, Zea mays
cuaccacgacguguuccugcccuacgugcacaaggugcgggagcugcaggacgcgacgcucuacgc

SEQ ID NO: 7698 - RNA, 93 nt, Zea mays
gguuaugacucaaacacaagggcauauagggucuuuaacaaguccacuggacuaguugaaguuucuugugacguuguguuugaugaaacuaac

SEQ ID NO: 7699 - RNA, 88 nt, Zea mays
acacuacuucgagucucauccggugacuguggugucauccuucccccuaggagagaucauccagugccgagaggccucggguaggauu

SEQ ID NO: 7700 - RNA, 134 nt, Zea mays
cgucgucacagggcaugcggggcgccaucauugccuaucuggcggagcuagccagaugggacaccggucuuguucucugcggcccgagucggcucgggguagggugaugauggcgcuuccuguugacguggcgg

SEQ ID NO: 7701 - RNA, 84 nt, Zea mays
ucaucggcuaucgagcgagucgacagcgccggugccccgaugggggacacgucgggcgucgaccucgcgucugagaugaagacg

SEQ ID NO: 7702 - RNA, 88 nt, Zea mays; identical to SEQ ID NO: 7639

SEQ ID NO: 7703 - RNA, 95 nt, Zea mays
acuaaacucuucacauguagauucguuaguagacccaaauaugauaucaucaacauaaauuuggcauacaaacaaaucauuuguaaguguuuuag

SEQ ID NO: 7704 - RNA, 77 nt, Zea mays
auucgauuaugaguacguagucgcgaagcauaauuuugcauuggauuaaguauuccgauaaguauuccgauugaaua

SEQ ID NO: 7705 - RNA, 82 nt, Zea mays
ggugguggcccaaacucuggaucagggagucgcuuuagagggcagcguccccgcugaucuggcguuuggcucuguugaaggc

SEQ ID NO: 7706 - RNA, 129 nt, Zea mays
acaccgcggagcagcucgagguugugcgccaggucaagaagcacaccagggacuacuaccagauccucggccuggaaaggacugcagugucgaggacgugcgcaaggccuaccggaagcucucgcucaa

SEQ ID NO: 7707 - RNA, 170 nt, Zea mays
  misc_feature (60)..(60): n is a, c, g, or u
ccuugauaaguccaccaaggcgcuugcucaggcggccgagcagagggaggccgaccacgncggccaugucugaugccaucucggcuuucugucgggucuuuggcuucgacgacguccccucgggaagcuccccucaaagucgccugcaggccuugggugaccaugcgcgu

SEQ ID NO: 7708 - RNA, 68 nt, Zea mays
gccucucuacucuuagaaggguuucguucugaaucucgggacgagauucuuuuaaggggggaagguug

SEQ ID NO: 7709 - RNA, 135 nt, Zea mays
uggcccccgggggaaggaugucuucgcccgagcuccgggagucuucggcgcggauguuggagguuaccaggggucgauggcccaaaaacguuccuaucccccgcgcggcuggcgaagacuucuuuacaucucgca

SEQ ID NO: 7710 - RNA, 109 nt, Zea mays
caccaagaucgacguguucgccuacggggucguccugcuggagcugguguccgggcgcgaggccgcggacgagagcggggagccgcugugggcggacgccgaggacagg

SEQ ID NO: 7711 - RNA, 205 nt, Zea mays
ucuuuccuaguccuuuaaccuugccuugguucccaucaccgaauaugauugaaucuugggaauccuuguucuugacguaggaggugaacaucuucuucucccccgucaugugguuugugcauccgcugucgauaauccagcuugagcccccggaugcauaaacccaacucuuguuggguccugcaagguuagugacaauagccuu

SEQ ID NO: 7712 - RNA, 272 nt, Zea mays; identical to SEQ ID NO: 7674

SEQ ID NO: 7713 - RNA, 67 nt, Zea mays
uugccccggugagaugcuugaugagaugauaguuuuucauccucauguguuucaguagagcuuguua

SEQ ID NO: 7714 - RNA, 113 nt, Zea mays
ccauuuuguuguggcauguagggagaagagaacucaugcuugauucccuccuccucaaggaagccuucgauuugagaguucuugaacuccgucccguugucgcuucuaauuuu

SEQ ID NO: 7715 - RNA, 118 nt, Zea mays
ccaggugggcgaccuggugcuucggcugcggcaagacgcccgagggaggcacaagcucacgcccccaugggaggggccauucgucaucgccaaaguucugaagcccggaacguacaag

SEQ ID NO: 7716 - RNA, 91 nt, Zea mays
uuaggcuccgcgguggaaucauugagcccucucugcaggcgcucgcucgcaaguacaaccaggacaagaugaucugccgcaaaugcuaugc

SEQ ID NO: 7717 - RNA, 83 nt, Zea mays
uggagaagaagacuucuuguauugucuccccgauagcaaggaaauuucugucugucgggagaugagcaagagcuucggauucc

SEQ ID NO: 7718 - RNA, 83 nt, Zea mays
uggggaagaagacuuuuuguauugucucccugacaacaaggagauuucugugugucgggagaugagcaagagcuucggauucc

SEQ ID NO: 7719 - RNA, 83 nt, Zea mays
uggagaagaagacuuuuucuauugucucccugacagcaaagagauuucuaucugucgggagaugagcaagagcuucggauucc

SEQ ID NO: 7720 - RNA, 83 nt, Zea mays
uggagaagaagacuuuuuguauugucucccugauagcaaggagauuucugucugucgggagaugagcaagagcuucggauucc

SEQ ID NO: 7721 - RNA, 83 nt, Zea mays
uggagaagaagacuuuuuguauugucuccgugacagcaaggagauuucugucugucgggagaugagcaagagcuucggauucc

SEQ ID NO: 7722 - RNA, 123 nt, Zea mays
ucauucaaaacuacuaggacggcaaucucaacuccacaaaggagaagauuuucaucggagaggaucuuucauggaaaucaaacuucaaaugcugggcuugcuuaucucaguggucaaucaguu

SEQ ID NO: 7723 - RNA, 75 nt, Zea mays
uucacaagggcggggcgcggcuuccgcggcgcaagugcagacgcugcugaagcugucgaucccgcgauaaagcug

SEQ ID NO: 7724 - RNA, 95 nt, Zea mays
ucauacucucuccguuucuuuuuauuugucgcuggauagugcgcaauuucgcucaaacauaggcaacuugaucaaaagagagggagcuccaggaa

SEQ ID NO: 7725 - RNA, 132 nt, Zea mays; identical to SEQ ID NO: 6755

SEQ ID NO: 7726 - RNA, 62 nt, Zea mays; identical to SEQ ID NO: 7543

SEQ ID NO: 7727 - RNA, 97 nt, Zea mays; identical to SEQ ID NO: 6833

SEQ ID NO: 7728 - RNA, 106 nt, Zea mays
aggacgagaagaagcggcgcgauggcggugggcgaccuggcguucaaggcgcugacggcugggcugggcgucgccacgcucuaccucgccgccaccuucucuguca

SEQ ID NO: 7729 - RNA, 74 nt, Zea mays
gcuguguucauccucggcuccagcagacccaugcaucaaccagcauggacugcggaucgauggaugcuguuacu

SEQ ID NO: 7730 - RNA, 75 nt, Zea mays
agguuuucugaaaugaccaggggcuucggagggagguucuauccgaggcacguuaggucaauucacaacucuacc

SEQ ID NO: 7731 - RNA, 279 nt, Zea mays
cggggggccacaucaaccccgccgucaccuucggccucuuccuggccaccauccccgucaccggcaccggcaucaacccggccaggagccugggcgccgccgucaucuacaacaaggacaagccccugggacgaccacuggaucuucugggugggcccucucgugggcgcugccaucgcggccuucuaccaccaguacauccuccgggcuggcgccaucaaggcccucggcuccuucaggagcaacgcgugaugagcggggcuuggcuguggagcaaug

SEQ ID NO: 7732 - RNA, 76 nt, Zea mays
guguuguguugugugggugcagcacgguagcaggcuagccaugcgcgcugcuguguugggucaccauccauccuau

SEQ ID NO: 7733 - RNA, 88 nt, Zea mays; identical to SEQ ID NO: 7592

SEQ ID NO: 7734 - RNA, 78 nt, Zea mays
gcgccucuggcgaggccugacugccugucagacucacucugucgaguggcacugcagucggaguggcgcaggcggcgc

SEQ ID NO: 7735 - RNA, 66 nt, Zea mays; identical to SEQ ID NO: 7225

SEQ ID NO: 7736 - RNA, 99 nt, Zea mays; identical to SEQ ID NO: 7086

SEQ ID NO: 7737 - RNA, 107 nt, Zea mays
cguugcgacgcugcucgcuggcccgcugcuggcuuggcugccgcugucgcacgcggcaugcccgccgaggccgagccggacagccgccgaccgagugcccgacagcc

SEQ ID NO: 7738 - RNA, 196 nt, Zea mays
ucucagaaaucuggccaagagcccuguugugguccagccgggucaggcaaguaacguuccuaucaggaauugauggagcaaauucuuucaagauaagagcauugguguucgcuggguuggcaaccaccagaacaugacugaauugagugaccuugcaguugggggccgcaugggcuucaagagcagaugcuugggu

SEQ ID NO: 7739 - RNA, 65 nt, Zea mays
gagaagaucaaggccaagcuugaggcugccaacaaggcugucucgaagauuggucagcacauguc

SEQ ID NO: 7740 - RNA, 88 nt, Zea mays
aacuacucccuccguuucuuuuuauuugucgcuggauaguguaauuuugcacuauucagcgacaaauaaaagaaacggagggaguauu

SEQ ID NO: 7741 - RNA, 90 nt, Zea mays
aacuacucccuccguuucuuuuuauuugucgcuggauagugcaauuuuacacuaucuagcgacaaauaaaaagaaagggagggaguacca

SEQ ID NO: 7742 - RNA, 127 nt, Zea mays
cagcagcagcagcaggagcagaagagggaaaaggcggcucguagcacccauccaucucaugaagcggaucgggucggaucggaucggagcucaccuuccuccaccuacugcuugcugaugugaugac

SEQ ID NO: 7743 - RNA, 102 nt, Zea mays
cuuccuuggcgcucuuuaauccuugcaccuuguuguacuccucccuacuuagagaggcgaggaguaugguuguggcuugggaguugaagugcucgauuuggg

SEQ ID NO: 7744 - RNA, 71 nt, Zea mays
gagaaacccgcccccgucgccgucgucggccuccagccgccgcgggcgauggguugcuuguuacccgauca

SEQ ID NO: 7745 - RNA, 162 nt, Zea mays
uaauucuauucuccaaaucuccaucuucguccaccuaugcgaagccuaccucggugugcugccgcauuuugguuuguggaaguaucuguaccauugucgcccugggauggcgggggggcaacaucaguuggucggaggugccaguuuggagaugcgccgugg

SEQ ID NO: 7746 - RNA, 76 nt, Zea mays
aaaggcucgacgucgucgucaccucucucgccguccacgagucacggcgggcgggcggcggcggcggccggggguc

SEQ ID NO: 7747 - RNA, 153 nt, Zea mays
uuguggaagagggcuuggaggaacccagugcaaagaucaauggucuacugcaagcguauauuucuagguugaaacuagaaggccuuucucuuaauucugauaucgucuacauuagacaguucucggguguucuugcuuggcccuucuuagcac

SEQ ID NO: 7748 - RNA, 77 nt, Zea mays
cucggcaaagggacuggcaaaggggcccacuggaggggacuggcaguggggcccacugggucagucuuugccgaggg

SEQ ID NO: 7749 - RNA, 65 nt, Zea mays
cggucagaaggggcaccggacuguccgguguguaccgaacaguguccggugcgccaacggcucgg

SEQ ID NO: 7750 - RNA, 60 nt, Zea mays
cggauuucgccggcgaccaggugguggcguaccugcucaucacggcgucggcggcggcuc

SEQ ID NO: 7751 - RNA, 151 nt, Zea mays
uuggaaccuggucgggcaagaauuauccgaggccgaaaagaaggagcuacaggaguaugguauauccuguggcuaccagccaagagccaugcucuuugguggggucgaugaaggggccuuaggaugcauucguguccgcaccggggcaaag

SEQ ID NO: 7752 - RNA, 259 nt, Zea mays
gucacaucaauauccaggccuaucaaacccucggauuuucgugauuuugaucuuauccuugcaauggacaggcagaacuaugaagauauauugaacucguuugagagauggagacgcaaagagccccucccugauagugcacccaauaagguuaagcugaugugcuccuacugcaaacaacauacugagucugaaguuccagauccuuauuauggagguccucagggauuugaaaagguguuggacuuauuggaagaug

SEQ ID NO: 7753 - RNA, 68 nt, Zea mays
accguuacuauuguauguggcagcuucgcacucugcagugagugcggcgcuugugcaggagaaacugg

SEQ ID NO: 7754 - RNA, 247 nt, Zea mays
ggcggcggcggcggcggcggcggaggcggcggaggcaguggcggugcgaacguggcuaauguggucaccgacgcguucuucaacggcaucaagaaccaggccgggagcgggugcgagggcaagaacuucuacacccggagcgcguuccugagcgccgucaacgcguacccgggcuucgcccauggcgggacggagguggagggcaagcgcgagaucgccgccuucuucgcgcacgucacgcacgaga

SEQ ID NO: 7755 - RNA, 95 nt, Zea mays
ccaacuagcagcagcaggcggggaguggaugcgccugcuagaagagugcuagcuccgcgcauacgcucgcucgacaaauguguguuguuaacuau

SEQ ID NO: 7756 - RNA, 76 nt, Zea mays
cagguucucugaaaugaccaggggcuucggaggaagauuucacccgaggcacguuaggucaauucauaacucugcu

SEQ ID NO: 7757 - RNA, 63 nt, Zea mays
cgucaugaggugcucaaggagucuggcccugaugggcuugaugucacauuggcguucuuuggc

SEQ ID NO: 7758 - RNA, 100 nt, Zea mays
auggcuucccucaccggauccgcucucuccuuugcgaggcccgucaagguauaucgccggaucaccucucgaguugccugaucugugagauaauccgauu

SEQ ID NO: 7759 - RNA, 140 nt, Zea mays
agagcuccagccgccggggcagccugcguucuucuucgguagagaaucaccuucagcuuuacgauuagauggucaaagcagcuauguauaucaccgugaugguuucaaauugggacagggcgucucggugaaugggguua

SEQ ID NO: 7760 - RNA, 120 nt, Zea mays
cacgaccgccgaagcagaugcgauauuaaaaucacgauaggcgaagauguuuaaaauuuagcaucuguguuauccacugauauuacgugcuuaaauccauacucguugucgagcagaaua

SEQ ID NO: 7761 - RNA, 219 nt, Zea mays
caggcucgguugcgacacagaucguagcggacuccucgccggacuucaccaaccgcgaccuccuacaggcggcccucacugacacucuaauccuagcgcgagauuacgagucaccugaagaucauccugguaccuggaaucucaagucucaggucaagaacagguaccacaggaugaggcgcauggaggaugcugcgaugaguucgugagugagaucua

SEQ ID NO: 7762 - RNA, 102 nt, Zea mays
caccggacaguccggugaauuauagcggagcagccgcugcguuuucccgaggcuggcgaguuccagaggccgcucuuccuuggagcaccggacacuguccgg

SEQ ID NO: 7763 - RNA, 111 nt, Zea mays
cggcaaagucguugguccacccaaggcauaucaccuaacuauggaagaacggaagucugcuuuacuguacauguucacgaauaugccugagguggagaaauacuuuguggu

SEQ ID NO: 7764 - RNA, 67 nt, Zea mays
ucaagcucaaucccgagaagugugucuucggggugccccggggcaugcucuugggguucaucgucuc

SEQ ID NO: 7765 - RNA, 287 nt, Zea mays
ccacuugggagccucugcaacaguucacagcaucguacccucuuuuucagcucgaggacgagcucguucgucgagggagggagagauguuauguucgacaaaguguacagccgaaggcccagaagggcagcugaucggcccauaguaggggucgaugcagauaagagauuagaggaggauuagauauguucuguugcaggauuguuaugcaacaaaucuaguccuuaaaauaaggagucuguuagcuaagucucaggauguggagucuguuaggaggacccggacua

SEQ ID NO: 7766 - RNA, 239 nt, Zea mays; identical to SEQ ID NO: 7422

SEQ ID NO: 7767 - RNA, 133 nt, Zea mays
cgucauggagcacgcggggugccaucauuacuuguuuacuggggcgaaccagaugggacgccgaucuuguuccccguagccugagcuagcuaggaguaggauaaugauggcccccuugcgauguggucggucc

SEQ ID NO: 7768 - RNA, 62 nt, Zea mays; identical to SEQ ID NO: 7213

SEQ ID NO: 7769 - RNA, 149 nt, Zea mays
uucuuagggcuuguucguuuugcucucaauccauguggauugggugggauuggauggguuucaaucccaaacaagucaaaaucuuucacaauuuuuuccaaucucauccaauccacaugggauaggaauaaccgaacaagcccuuaguu

SEQ ID NO: 7770 - RNA, 55 nt, Zea mays
guguuuuuaaggcuucgccgagugcuuccggcacucggcgaagcuauugauuccg

SEQ ID NO: 7771 - RNA, 65 nt, Zea mays
cccagaauaugauccgagcaccgagcagaucgacuccgaugugcucaugagggucggaggaagca

SEQ ID NO: 7772 - RNA, 84 nt, Zea mays
caagcgacgcccgacacggguuagaugcacgugggccacaccuguggcacaggccggccugcuaacugugucgggccagcacgu

SEQ ID NO: 7773 - RNA, 65 nt, Zea mays
uuuggaggcgcugcgaugggcugucugcaaacaaagcacgccagucgaucgccgcacuugcugga

SEQ ID NO: 7774 - RNA, 329 nt, Zea mays
uccaagaccaagacauguguugcugacuugcuguugcuguccaaagaaaaucauguguugcugacuugcuguccaaguuguuguccaaacuccaaagaaaauccuugcuguccauagagaugaagccuaaaauaucauuguuguaaugcuauuuuuguucuuugcuggcuugcugcccaacaguccaaguuuguguaauaagagaccuuucuuguuuuguugaauugaauacuuuaaaguuuuguucaaguguaaacucuauauacucauauauugcuugcaacuugcuccuguaacaauaaucagauuuauuaugucuuguuuuuuug

SEQ ID NO: 7775 - RNA, 78 nt, Zea mays
auaacgcuaagaccgggcgggugacuugcacgagaagagagucucgguguagugucuccgucugagucgauuaaggcc

SEQ ID NO: 7776 - RNA, 70 nt, Zea mays
agcuagaugaucccuccacguccgaagcacaaccaguggcauuuaaggcgacggaggagaagaaggagga

SEQ ID NO: 7777 - RNA, 131 nt, Zea mays
ccauuagcaggaggcacucgcguuggggucgcucaucgacgacaagaagaaacuuggcgacugccaguucgaccucuagaaacaguccuacguuuggacgcgccgcuuggacgcgacugccgcuuggacgc

SEQ ID NO: 7778 - RNA, 70 nt, Zea mays
caucucgcccgaucuagcggugguugcuccuggucucgucgcuguagagccagucguagacgguggggga

SEQ ID NO: 7779 - RNA, 169 nt, Zea mays
auuuggagacagggaugagacagagcaugggauggggcuaucaacaaaguggagggacuagcuugugaggcagaaagaaggugccagugccggugccuccccggugaaacgaugaugggaguguuguugcucccuccccugcacugccucuucccuggcuccuccgauc

SEQ ID NO: 7780 - RNA, 132 nt, Zea mays
agagagugcgauguuggcauggcucaaucaacucgccggccgcggguggcuuagcuuauuaauucugcguuuuugaucgaggugcgggcgcaguguuuaauugauugagccgugccaauaucacaaccuucu

SEQ ID NO: 7781 - RNA, 88 nt, Zea mays
cauuuggugcuucggagaguggccaacccagauacaguaggcaagcuacagcugaaaugggaaggaccuuuucugguaguaucuucgu

SEQ ID NO: 7782 - RNA, 76 nt, Zea mays
acccuguacgguccuggugcaccggacacuguccgguggcacaccggacaauccggugcgccagaccacagcacac

SEQ ID NO: 7783 - RNA, 117 nt, Zea mays
acgacaccacgucgcaccugcucaccugggccuccuuccugcugagcacgcacccggaguggcagcacaggcuccgggacgagguccggcgggagugcggcgacgacgaggucccca

SEQ ID NO: 7784 - RNA, 84 nt, Zea mays; identical to SEQ ID NO: 6851

SEQ ID NO: 7785 - RNA, 61 nt, Zea mays
gcagcucuacucuaaaacucuggguggagcagcucugcuccagaguuuagauuguuucuca

SEQ ID NO: 7786 - RNA, 69 nt, Zea mays
ccugcgggagcuagcuguggucccagucccugcggggggucaggacacacagcucgagcgaauccgcga

SEQ ID NO: 7787 - RNA, 66 nt, Zea mays
uuucugagaugaccaggggcuucggaggaagauucuauccgaggcaugucagguccauccauaacu

SEQ ID NO: 7788 - RNA, 121 nt, Zea mays
ggagcugauuuggugacccgggaucccaggaggaucggaggggauugagaaggaaauuaguugauuucccccuuaauccccuucaauccucccgggauccccuugucaccaaaucagcccu

SEQ ID NO: 7789 - RNA, 129 nt, Zea mays
cgucauggagcacgcggggugccaucauuacuuguuuaccggggcgagccagaugggacgccggucuuguuucccguagccugagcuagcuaggaguaggguaaugauggcccccugugacguggucgg

SEQ ID NO: 7790 - RNA, 84 nt, Zea mays
cgccuucgucucgaacgcgaggucgacgcccgacgcgccccccguuggggcgcuggggacgucgauucgcucgacagccgacga

SEQ ID NO: 7791 - RNA, 186 nt, Zea mays
cgagaugccgcuguacgacugcaugcugcugcugaagacgacggugaccagggagguccuagcggaacuggugacgcggguggcgcgccgcgcaugccagcgcaacggggucgucaccgacgucaagucauucggcaaggucagccucgccuacggcaucaggaagcucgacggccgccacuucca

SEQ ID NO: 7792 - RNA, 244 nt, Zea mays
ugacuccggggggucaggccgauccgcuugucccccaagagcaggugcccgcgcuggcugcacaggaggccggucccucggccgucgugacgacgccugggcaggccgcucccucggcggcucgggcguccgaggcggaaauggugccgaagccggcggcggggcagcccucgggagcgccugcggggauaggggcccgaggggccuccccacaggcacgauuggccuugccccggagcggcaa

SEQ ID NO: 7793 - RNA, 216 nt, Zea mays
cuaguagagaggcuagcuaggugguccucgaacgaagauguugggggaguucaccguuuaggcgguggaggugccgccgcaucuggugucggcgggcagccguacgccguccucccaagacaaaggcgucgcagcugauggugcgcuuccugcccgacuccaagccggccguggccgugcagcucggagaccacuuacaccucgccuacucccacg

SEQ ID NO: 7794 - RNA, 109 nt, Zea mays
auggacaucucgaccuagaugagggagguaacccgguugaucaaacucucuaccguuccaugauugguaguuuauuguaccuuaccgcaucuaggcccgauaucauguu

SEQ ID NO: 7795 - RNA, 77 nt, Zea mays
uagcaauuaagcaugugucgaguucagcucuaucaaaaucuacuaaguaagcugacccucuaacacacccuuaaaug

SEQ ID NO: 7796 - RNA, 150 nt, Zea mays
gucgcauaucauagcaccagcacaguagugaaacaccaacagcaacgcagaucgucgccagaucagccuacaaucauauggcguuuacaauaucuaugggugagaucaauauuuaauauuuuauugucugcgcuuguuaugucaaagugc

SEQ ID NO: 7797 - RNA, 98 nt, Zea mays
cgucugggugaacugcuucgacgucuucgaugcugcgauuccguuugguggguacaagaugagcggcaucgggagggagaagggcguugacagccuga

SEQ ID NO: 7798 - RNA, 214 nt, Zea mays
gcaaaggaaaguucuaugccugauacuucugagcucuucacaaauguuuauaagaagggauucaacguggagucauuuggaccugacaggaaggaguugagagcuacucuucccuagguugggagcagaauggcgguccucaauaugauaugauagccaggagaaauaaacauugaugaagaaggccucagacauugcuggaauucuuuuguug

SEQ ID NO: 7799 - RNA, 82 nt, Zea mays
agucgucguaggcagcgagcgucucuccucucccacgcaucgcgccaaggaagagagagagaucgccgcuccccuucucggc

SEQ ID NO: 7800 - RNA, 66 nt, Zea mays
uauacaaucugcugcagcuauaccggccaagaguauggcaugguauggcggcaggcagccgcaaac

SEQ ID NO: 7801 - RNA, 84 nt, Zea mays
uaggcuuuucaggucuaauuaaucuacugcuggggcacacgggcccauuugccagcggggauuggauucuaccugaccucacaa

SEQ ID NO: 7802 - RNA, 132 nt, Zea mays
cucauuuggcccuguuuagcauggcuccaacuccauagauuucuacuaaacuccauaacuccauguggagcagacuccgcguggaguuggagccaacuaggaggagguguuuggcuagcagggugucccuaa

SEQ ID NO: 7803 - RNA, 223 nt, Zea mays
aagcuuaauaccccuccuaaaagauugucuaacuuuguuagagcaaagcucccauggcucaggauaacgaggguuacauuuuauauccugucgguuaucccgagcacaaaauuaggagaauucacucuaggaagucucacucuggcucucaucaugcuuuuauguauaagaguuuaugcauccgggggcacaaguuggaucaucgauagcgggugcacaaacc

SEQ ID NO: 7804 - RNA, 108 nt, Zea mays
uaaaaguugaucgucaaguggccaucaucuaacaacacuaacauaguguuaucccagguuauaauuuuguucuguuguggauggugcuaagugccggugggcucggcc

SEQ ID NO: 7805 - RNA, 116 nt, Zea mays
cgagaagcaguuccagaggcugagcggcuuccuggccgaccgcaggguggcgucuuccgugguccacggcggccacuucaaccccaagacgcugagcauggagcccacgcuucugc

SEQ ID NO: 7806 - RNA, 65 nt, Zea mays
ggguuagguaccauggcaacuacaaaggccuccacauugaccuuguauugccuggaaaggaugcu

SEQ ID NO: 7807 - RNA, 231 nt, Zea mays
ucgagccaacuucgucucuguucauacugauaucgcuaccccuggccucggcucgucgaagagcggccaaggggucccuuuaacuaagcuaggggagccucagacaacaaggccgaccgagccgagggacuccuacgccuccgggauacggauaccucacucgucaccuugacacggggcgacucaugcuuggugaagcgguucagauaaucaacaggcgagucuuagugc

SEQ ID NO: 7808 - RNA, 73 nt, Zea mays
ccuccguuuuguuuuaguugucgcuggauagugcaaaauugaacuauucagcgauaacuaaaaagaaacggag

SEQ ID NO: 7809 - RNA, 69 nt, Zea mays
cucuuccgccccacuuggaaaguuaccaacucuuagugaguugaacuaugacgagugggccgauaagau

SEQ ID NO: 7810 - RNA, 68 nt, Zea mays
ucuuccgccccacuuggaaaguuaccaacucuuagugaguugaacuaugacgagugggucgauaagau

SEQ ID NO: 7811 - RNA, 196 nt, Zea mays
cggaugggaggacgagcugugggagcgggcuagggacggagcggcuccguccuauugauuuuuuggagugggaugguuccggaucugaggagaauauuuccuaauuggagccacuccguucuaguuacuuuguaacaaacaacaacaaaacugagacaaaacgacuccguucuacuuggcucuucaaccaaacacu

SEQ ID NO: 7812 - RNA, 210 nt, Zea mays
gggcuuggcgagcuucacgggcuacuggcggagcuagccgaagcacuggcuugcccagaggauggcuggggggggggcuggccacgguggccgaagcucuggcggcaauggcgggcggaauugagcucgccggagcuaagggaaaggggcuggccggugagggugagugcggggcgaagagaggugcgcccggggaggcuuuauaggcgc

SEQ ID NO: 7813 - RNA, 155 nt, Zea mays
ggauguauucgccuggucugcccucgaucuggucggggucagccgcuccaucaucgaacacaaccugggcauugaccccuuggugcgcccgaaaaagcagcggcugcgaaaaauguccgacgagaaaacggaggcagccaaggccgaagugcauc

SEQ ID NO: 7814 - RNA, 271 nt, Zea mays
gcuggcagugaccuguauaucauggagagcuuucaugauuauaagaugguugauaaucgcucuauuguagagcaagcucaugaaauacaguguauagccaaggagcucgaccaccuuaagauuguccuuccugaccgauuuguggcuggaugcauuauugcaaaguugccuucuacauggaggaauuucgccacaucucuaaaacauaagagacaggagauaucaguugaaaaucugauagcgucucuggauggggcgagggccacuagca

SEQ ID NO: 7815 - RNA, 102 nt, Zea mays
gcgcuuggacgagccugcgguuggugugccuauuaagaagaggccauuuuucuugucugaccgaucgguugcaucugccauaccgcucucgacaaagccccc

SEQ ID NO: 7816 - RNA, 88 nt, Zea mays
auaugacucaaacacaagggcauauagagucuuuaacaaguccuccggacaaguugaagucucaugugacguuguguuugaugagacu

SEQ ID NO: 7817 - RNA, 124 nt, Zea mays
augcucgguggagccuaacguggauugcccugaggccuucacaacugagcuuguggagaccuaugguccuauugacgcggcgcccgaugugggggcuaauccuauggaggacuucgcugagcuc

SEQ ID NO: 7818 - RNA, 79 nt, Zea mays
aggcuguuucggucuggggcaccggacuguccgguggugcaccggacaguguccggugcgccaggcugccucgaccuga

SEQ ID NO: 7819 - RNA, 68 nt, Zea mays
ugcucagucugggugcaccggacuguucgguggugcaccagacaguguccggugcgccaagcuggcgc

SEQ ID NO: 7820 - RNA, 141 nt, Zea mays
cgcuccacagugcgcagccaaucuucagcauccaugggaucagaagagugagcgaacaccgggggaugaccucucaugaauucagcacgcuugucucugggcaucugaggcugaggugguggcugcugcuacugcugaaug

SEQ ID NO: 7821 - RNA, 81 nt, Zea mays
ucuuuugccgagugcccaauauguggcacucggcaaagaagccucuuugccgagugccagcaguuggcucucggcaaagac

SEQ ID NO: 7822 - RNA, 66 nt, Zea mays
gaaagaaaaggauuggaaaagaguuggcuguguacagccaacugcugcucagucugggugcaccgg

SEQ ID NO: 7823 - RNA, 77 nt, Zea mays
gaugcauuaaaugcugagagggcacgucgcccgucagcgcaguggcaggcgacgcgucuuuuccucaauaaaugcag

SEQ ID NO: 7824 - RNA, 90 nt, Zea mays
uguuacucccuccguuucuuuuuauuugucgcuggauagugcaauuuuacacuauccagcgacaaguaaaaagaaacggagggaguacgu

SEQ ID NO: 7825 - RNA, 270 nt, Zea mays
gagcgcucggcuacuugagguagggauggcagcgggucggauuauguucggaggcacucagcuauaauucaccggacuguccgguguacaccggauaguguccggugcuccaaggaagagccgccucuggaacucgccagucucgggaaaacgcagcggcugcuccgcuauaauucaucggacauguccgguguacaccggacuguucggugcaacuccgaagcaacggcuacuucgcgccaacggcuaccugcagagcauuuaacgcgc

SEQ ID NO: 7826 - RNA, 75 nt, Zea mays
cgccggggccgcacugccgcuccacgugcgcccgcguccgcgcccgugacuacuggaggcagugcaugcgggggc

SEQ ID NO: 7827 - RNA, 139 nt, Zea mays
uagaagucacugcugaugccuguucaguaggguuuauccuugcuaggaucugucgcaacuucaucagcccgcuuccuuuugucacauucaacagccaaaacagugaagcuuucuacugcaggcucaccaguaccucggc

SEQ ID NO: 7828 - RNA, 95 nt, Zea mays; identical to SEQ ID NO: 7755

SEQ ID NO: 7829 - RNA, 315 nt, Zea mays
auguguacuccaggggggcggccuguccgaguucuccgggcucaggagcuccgcgucgcugcccaugcgccggaaugccaccuccgacgacuucauguccgccgucuccuucaggacccacgcggucggcacgagcggcgggcucgcggcgggcgccgacggaggcgaagcugaagguggccaucaauggguucggccgcaucgggcgcaacuuccugcggugcuggcacgggcgcggcgacgccucgccccucgacgucaucgccaucaacgacaccggaggcgucaagcaggcguuccaccugcucaaguacg

SEQ ID NO: 7830 - RNA, 74 nt, Zea mays
augguggguacaagugcggucacuguacggcggcagccggggucaguggagcauuguacgcuucagggcauggu

SEQ ID NO: 7831 - RNA, 74 nt, Zea mays
aaguuaucuggugcacaugcauggccgucugaguucuuugagacaaggacaggugcaugugggcccgauaccuu

SEQ ID NO: 7832 - RNA, 89 nt, Zea mays; identical to SEQ ID NO: 6983

SEQ ID NO: 7833 - RNA, 136 nt, Zea mays
gucggcgaggagggcagcaagaccgagccgugcgggggcucgggacgggaacgggacaggaccccaaaaucucagauccuuccugcgcgcccgcccgugcccgucggcgcgucguucuugccguccgcgccccacc

SEQ ID NO: 7834 - RNA, 125 nt, Zea mays; identical to SEQ ID NO: 7045

SEQ ID NO: 7835 - RNA, 125 nt, Zea mays
auuucuucaggugcgaugcuggauacgaggccagggcagauguggugucuacgacgugcuguaagaagcucgucguggacaugcacuacgaggcgcgcauccaggccaucgucacuuaccacggc

SEQ ID NO: 7836 - RNA, 242 nt, Zea mays
uuggaugccaaaugggaggacuaaacaugagcugauuauaaaacuaauuacauaaacaguggcuaauucgcgaaacaaaucuauuuggccuaauuagucuacuauuagcacuuguuuacuguagcaaaacaugagcuaauuauagauuaauuaugcuugauaaauugucucgugaauuagcaaaaaccuguacaauuagcucuauaauuagaucauguucaguucuccuaauuggcauccaa

SEQ ID NO: 7837 - RNA, 62 nt, Zea mays
gccgacgucuccguggagaaccccaacgccgcggcguucagguucucgcggaccgagacaga

SEQ ID NO: 7838 - RNA, 93 nt, Zea mays
aaucaugcuuacagguuguccaaggcgcuauauggguuaaagcaagcuccaagggcuugguaugagcgucuucgcgacuuccucaucgaaaag

SEQ ID NO: 7839 - RNA, 65 nt, Zea mays
ucaaggugacgagugagguauccguaucccggaggcguaggaaucccucggcucgaucggccuug

SEQ ID NO: 7840 - RNA, 65 nt, Zea mays; identical to SEQ ID NO: 7839

SEQ ID NO: 7841 - RNA, 181 nt, Zea mays
cugcuaguccccgacgacaucuauagcgaccaaccauaaguuguuaaauuucuagacuuuuagcgaccaaccgaccguugcuauaaaaggauuuagcgauugacugucgguuccuaaccuuuagcaaacaacaguugguaccuaauaagggucgcuaaagaucaaucgucguguaguguau

SEQ ID NO: 7842 - RNA, 88 nt, Zea mays
acacuacuucgagucucauccggugacuguggugucauccucccccuugggggagaucauccagugccgagaggccucggguaggaua

SEQ ID NO: 7843 - RNA, 297 nt, Zea mays
ggugugcaccagacauguccagugugcaccggacauauccggugagccaacggagcaacggucaacugcgccaacggucgacuguggugaacaguaaaaagugcacagugcagaaguuagaagucagagcuacaaagucagaacacaccgaauuguccggugugccagcggacuguccggugcagcaagaggacaaaagacuucaacggucaaaugcuccaaaccccaacggucuacugacguggcaggcaccggccagugaacagugucauguucggugcaccacuggacuguccg

SEQ ID NO: 7844 - RNA, 261 nt, Zea mays
ugauuuguuccgcugcuuugcgccuccgugcucucgcagaucccuuggggccgucucgccuccgcgcgacgccggcagcgagcugaguuugguuucgccggguugcucgguuuccgguuuauucuucccgcgauuuuaguuuuugcgucgauccuguuucguccucgccuucucagcguguggguugcaggauuuuggguccgauccggucuuaggcgaauucgucguggcgucggguggcgaggaguugggaggcagguc

SEQ ID NO: 7845 - RNA, 286 nt, Zea mays
ucuauaucucugauguucuguaaugucugcaagacgggugagacguuccugguaaggaaugaucuaugggucgcggaugcagccauccgcuacuugcaagaccaacucgcgaaacgagauuuagcacucgauuggaugguuaacucucguuuacucgccugggcuaaggaagccaaagcucgagcccauguggaggagcuuagcuuagccauggauaacuugcagguaaaguugcauaauugccacccaacagacucagauaguacagugucaucagaaaaagcaa

SEQ ID NO: 7846 - RNA, 82 nt, Zea mays
uuugcuaugcccaucggguacggugggcguggguauguucuauguuuccccauacccgcuacccgauggggaacccgcuaau

SEQ ID NO: 7847 - RNA, 78 nt, Zea mays
aauggaaaacuagauaaggauguguauaugauacaacccgaggguuuugucgauccgaucaaugcuggaaagauaugc

SEQ ID NO: 7848 - RNA, 132 nt, Zea mays
ugagccgggguucuaccucccgcaugggcuggcgacccgguucuuccuccggcguucgggggagaggggcauccuccaguugugcggaggaggcguccuccagccaugcgggggaaggcgaacugcugcugc

SEQ ID NO: 7849 - RNA, 170 nt, Zea mays
uaucuuauugccacuacugcuaaucacuuacacaugcuagguguauggcuaacucuggaauguuuuuaugguuacauugaugccaggauugaacuuaacaaugaauuuauaguaguucuuaagugcucuaaguaugucgcugauauugaauauggugugguagaaaugga

SEQ ID NO: 7850 - RNA, 77 nt, Zea mays; identical to SEQ ID NO: 7118

SEQ ID NO: 7851 - RNA, 77 nt, Zea mays; identical to SEQ ID NO: 7118

SEQ ID NO: 7852 - RNA, 70 nt, Zea mays; identical to SEQ ID NO: 7289

SEQ ID NO: 7853 - RNA, 77 nt, Zea mays
uguggugacaaggaacaaagcccgacuuguggccaagggauauucacaagucgaagguuuggauuucggugaaaccu

SEQ ID NO: 7854 - RNA, 85 nt, Zea mays
acuggagcuuggaccuggcguccuguaguccugugcgucgcguacucgcguggaggaauacagagauggcagauuggcagccuag

SEQ ID NO: 7855 - RNA, 157 nt, Zea mays
ucuggcgcaccggacuguccggugugccaccagacaguguccggugcacuagggagaucaacuccaaacuugccaccaucggguuucuggaaaugccacaccgcuauaauucaccagaacuguccgguguagcaccggaacuguccggugugccagc

SEQ ID NO: 7856 - RNA, 75 nt, Zea mays
uugcuucugaguggaauguugucugguucaagaucuacaagaucucggaccaggcuucauuccccucaggaauag

SEQ ID NO: 7857 - RNA, 73 nt, Zea mays
cucagcacagucuggcacaccggacuguccgguggugcaccagacaguguccggugcgccaggcuggucucca

SEQ ID NO: 7858 - RNA, 73 nt, Zea mays
gaccccucagcaugcacaucagauggcccauugccauuauuguuuggugccaucaauugugcaaaagguuuca

SEQ ID NO: 7859 - RNA, 80 nt, Zea mays
guguuguguugugugggugcagcacgguagcaggcuagcccaugugcccugcuguguugugucaccaggcaucuauaaua

SEQ ID NO: 7860 - RNA, 100 nt, Zea mays
ugacugcggcggaggccucgagcgaaggguggcaucuuugccuucgccccaacacuggugaaaaggucgcucuugggaauucgucggcggcguacgacua

SEQ ID NO: 7861 - RNA, 215 nt, Zea mays
cuggacaugcccauggugaaguacuugggcgaaugaacccuuuguccaacaacucuugcaacugcuucuugaguucugcuuacucugcuggaggcauccuauagggucucuuggauauaggugcagucccggguugcagcucuauggcaaacucuaugucucugucggguggcaucccuggcaauucgucuaggaaaacaucaggguacucacag

SEQ ID NO: 7862 - RNA, 64 nt, Zea mays
acucggcauaguccuacucucgguaacgacgguguuugccgagagcaggacucucggcacagga

SEQ ID NO: 7863 - RNA, 117 nt, Zea mays
ugcagcagccccuggcguuguugucuucuucggcagcaugacgaaggucagugcuuugucgaagguuguggaagugaguacaccggaggugggcgccaauguuggggacuuguucuc

SEQ ID NO: 7864 - RNA, 73 nt, Zea mays
gacggugucgcugauuguagcucgaugguucgugacggaugcacgagaaaagagucgggcgauuucuacaggu

SEQ ID NO: 7865 - RNA, 71 nt, Zea mays; identical to SEQ ID NO: 7208

SEQ ID NO: 7866 - RNA, 71 nt, Zea mays
ucggguacugcggcacgaccgacgaguacuguggcgacgggugccagucgggcccgugccgcucgggcggc

SEQ ID NO: 7867 - RNA, 71 nt, Zea mays
ucggcuacugcggcacgaccgacgaguacuguggcgacgggugccagucgggcccgugccgcucgggcggc

SEQ ID NO: 7868 - RNA, 76 nt, Zea mays
gggaagguacaccaagaugacgcccgaggagauucuugggaaguuugugagcgggcgcaugauggugaaggaggcu

SEQ ID NO: 7869 - RNA, 76 nt, Zea mays
uccuagguacaccaagaugacgcccgaggagauucucggaaaauuugugagcgggcgcaugauggugaaggaggcu

SEQ ID NO: 7870 - RNA, 75 nt, Zea mays
aagaagacgacccucugugccaucguggaccguccgacccgcaggcauggaccguucagcccugugccgcagacc

SEQ ID NO: 7871 - RNA, 93 nt, Zea mays
ccugacuuagacuggcgacaugaaccgguggaucccucggugguauauguacucuucgacggauucauugacucgucgucggugagaucucag

SEQ ID NO: 7872 - RNA, 88 nt, Zea mays
auaugacucaaacacaagggcauauagagucuucaacaaauccacuggauuaguugagguuucuugugacauuguguuugaugagacu

SEQ ID NO: 7873 - RNA, 167 nt, Zea mays
ccaucgugagcgacgaguuccgggaggcggaggaggagaaggagcggaagcgccgcgcggcggccgccgacgugcccaggaagucggccgcugagaugguggccggcucgccgugcagcggcggcgggcagaucuucuucaccaccggcaucgucgucgcaugaugg

SEQ ID NO: 7874 - RNA, 90 nt, Zea mays
cggcucucuucggcgcuggauacuggcugaacguccacagcuucuacuauuuccuggucguucagaugguuuccggccuguuucagucgg

SEQ ID NO: 7875 - RNA, 505 nt, Zea mays
uccgaauggggcgccaccaggcaggccgccgcgcccaggccgcccaccgucuccauggucguccgcgccuccgccuacgccgaugagcucgugaagaccgcgaaaacgaucgcgucgccggggcggggcauccuggcgauggacgagucgaacgcgacgugcgggaagcggcuggcgucccaucgggcuggagaacacggaggccaaccggcaggcguaccgcacgcugcuggucacggcgccgggccugggccaguacaucuccggcgccaucccucuucgaggagacgcuguaccaguccgcgcgccgucgacggccgcaagaucguggacauccugggcggagcagggcaucgugccggggaucaagguggacaagggccuugucccgcucgccggcuccaacaacgagucguggugccaggggccuggacggccuggcgucccgcgaggccgccuacuaccagcagggcgcgcgguucgccaagugggcgcaccgucguca

SEQ ID NO: 7876 - RNA, 153 nt, Zea mays
ccgccuccgcgcgcggcuccgggagcaccacaccggcacagcgaaaccuccucuccgcgcgaccgaacucagaucucgacgccgccgagcuucagaaggacggcuccgggcuccaggcggggggugcuuuccgccgccgcgacgcagauccga

SEQ ID NO: 7877 - RNA, 92 nt, Zea mays
caagaggaggaccaggagcaggcuucagaggcugcuauugaggaucuccccgcagccccagcaauugaaggcaagccccggugcucucaagc

SEQ ID NO: 7878 - RNA, 102 nt, Zea mays
cuaauguuacugccauguucucagccucaguuugcuccauagugggggaugguguugguacacuguuuuggacugaccgcugguugcauggccaauguaucu

SEQ ID NO: 7879 - RNA, 142 nt, Zea mays
cuucgcaaaucaaccaaguuguggcaccuucggcuacgaagcuggugcucccaaucacaggugggucagguucuaaaccagccaauaagaaguagaagaaagaagcacaaagaaggguacaacauguuggggugcaaggacc

SEQ ID NO: 7880 - RNA, 231 nt, Zea mays
gcccgccaacuccgccucuguucgugcugauaucgcuaccccuggccucggcucaucgaagagcggccaaggggucucuuuaacuaagcuagaggagccucagacaacaaggccgaucgagccgagggacuccuacgccuccgggauacggauaccucacucgucaccuugacacggggcgacucaugcuuggugaagcgguucagauaaucaacaggcgagacuuagugc

SEQ ID NO: 7881 - RNA, 72 nt, Zea mays
gccggcucaguugcaccugcaacaugagcagccucagcuggugccgcaguugcagguguugcaguugcaguc

SEQ ID NO: 7882 - RNA, 76 nt, Zea mays
ccgcggaugucuggacuuauauccgggccgucgagcgcucugggcucgagggcucggaugagucggaguacuccuc

SEQ ID NO: 7883 - RNA, 72 nt, Zea mays
ucgagcccccacgugugccaucuggaccuucugccacgggagguccagcgccaccacguguccgggcuauua

SEQ ID NO: 7884 - RNA, 69 nt, Zea mays
gggaucuugcagcagcuggacuauggccugguugaaugccaggcccugguccuugcucccacccgugag

SEQ ID NO: 7885 - RNA, 123 nt, Zea mays
auuugcuuccaucuaggcuagcuuggcgaggacuucgccaagcgcaucuuugguugcugggaauuauuucucggccucccgggugcacuugaucuuugcggccuggccaagaugguugauggu

SEQ ID NO: 7886 - RNA, 73 nt, Zea mays
ccgucgcccggguggaggacggacaguugcacccuguccaggaagcaacaguucgccuucccucgcauggcug

SEQ ID NO: 7887 - RNA, 92 nt, Zea mays
cuucccggaacccugcaucgaccgccuugccccgcacaucggcaaguacgaggcguuggcguggcugugcggagggcuaggguucuucgcug

SEQ ID NO: 7888 - RNA, 71 nt, Zea mays
uuuuuuauucccacccacaugcauguggcucuguggcgcgcagaccguugugcauguggaggagagaagcu

SEQ ID NO: 7889 - RNA, 88 nt, Zea mays
uuucuuccugugcacaccacugauaaggcucauaaguaugcagaguuguacaauauugaccgaauuguguguuugcacggauuaccuu

SEQ ID NO: 7890 - RNA, 83 nt, Zea mays
cggagaagaagacuucuuguauugucucccugacaacaaggagauuucuguuugucgggagaugagcaagagcuucggauucc

SEQ ID NO: 7891 - RNA, 262 nt, Zea mays
gaucagcggcgacaacgcgacugcaggaggcugugcauggguuccuggcgugacguccaguguggcagcggcuugccgucuucaggcuacgacacguggcuuccuggcgcggcgucaagcacagcaagcagcggcuugcccucuucagguugcggcacuuggcuuccugacguggcgucaagcacgacaagcggcaacacgguugcaggcuacgguccgccguucccuggugcagcgacuugcaucgguauugcgcguugaa

SEQ ID NO: 7892 - RNA, 75 nt, Zea mays
auaucgagccagcucggcucguuauggcucggcucauuauagcucguuacuguaacgagccagcucggcucggcu

SEQ ID NO: 7893 - RNA, 73 nt, Zea mays
ucuagcucuugcgccaggucguggaccguccgacccucggucacggaccguccgcgccucugcaaagaucacc

SEQ ID NO: 7894 - RNA, 74 nt, Zea mays
gguacccaagguuuaugcauccgggggcucaaguuggaucauugauagcgggugcacaaaccacaugaccgggg

SEQ ID NO: 7895 - RNA, 59 nt, Zea mays
uggugcugcuggaguccuggcuuucgugggcuacaagcucgggacugccgauaugccgg

SEQ ID NO: 7896 - RNA, 63 nt, Zea mays
uugggugaaggcgacaggauuucuugguggcuccaaggauguucugccgaccauuauaucucc

SEQ ID NO: 7897 - RNA, 88 nt, Zea mays
uuaugauucaaacacaagggcauauagagucuuuaacaaguccucuggacuaguugaaguuucuugugacauuguguucgaugagacu

SEQ ID NO: 7898 - RNA, 70 nt, Zea mays
uggagcagugguguagugauugcgaggauccguucgcucggagccuuggaucaucaacaucgagaucucc

SEQ ID NO: 7899 - RNA, 120 nt, Zea mays
cuuggaucgaugacacacccccuaccuggcgcgccaguugucgguguuuuggguccgaccgcgcacccgggguuaccccucaaggugcuuuuaggaguaggacaguguuaccgacuguag

SEQ ID NO: 7900 - RNA, 116 nt, Zea mays
cucuguuccgguauuaaauguagucggauuauaaaacuaauuugucagucaaagauuaaaagacgagacgaauuuaguccaguugguugggucuauauuucauacuccuauuuaaa

SEQ ID NO: 7901 - RNA, 65 nt, Zea mays
ucucggaaaugaccaggggcuucggaggaagaauccaccugaggcacgucaggucaauccauaau

SEQ ID NO: 7902 - RNA, 77 nt, Zea mays
agaggguuagaaacugauauaucagccgugcucacgagauacuugaucagagaugguugguuuacagaugaugauga

SEQ ID NO: 7903 - RNA, 64 nt, Zea mays; identical to SEQ ID NO: 7238

SEQ ID NO: 7904 - RNA, 90 nt, Zea mays
aggccaccugcccgcucugccgcgccuuccuccuccccggccucagcgccggagacggcgacggcgacggcgacggcgagcucgccuccu

SEQ ID NO: 7905 - RNA, 69 nt, Zea mays
cccgcgggagcuagcuguggucucagucccugcggggggucaggacacacagcucgagcaauuccgcga

SEQ ID NO: 7906 - RNA, 262 nt, Zea mays; identical to SEQ ID NO: 7620

SEQ ID NO: 7907 - RNA, 72 nt, Zea mays
ggcucccaugccucaggauaacgagggcuauauuuuguacccugccggcuauccugagagcaaaauuaggaa

SEQ ID NO: 7908 - RNA, 81 nt, Zea mays
uagcauuuaaggguguguuagagggucagcuauacuuaguagauuuugaaagagcugaacucgacacaugcuuaauugcua

SEQ ID NO: 7909 - RNA, 201 nt, Zea mays; identical to SEQ ID NO: 6817

SEQ ID NO: 7910 - RNA, 136 nt, Zea mays
cacucggcaaagauuccaucuuugccgagugccaccugggacacucggcaaaggaccgccagggaggguccucaugugagguucuuugccgagugcuacgugcggcacucggcaaagcgugccucuuugccgagug

SEQ ID NO: 7911 - RNA, 93 nt, Zea mays
agcugauacagcucuuggagguuccugggcggaucccugaugcaguggcuguaaaggacaccggcccgaaggccacugauggcguaguggaug

SEQ ID NO: 7912 - RNA, 71 nt, Zea mays; identical to SEQ ID NO: 7009

SEQ ID NO: 7913 - RNA, 178 nt, Zea mays
aggcccuguuucaaucucaugagauaaauuuuagcuuccugcuaaacuuuagcuauaugaauugaagugcuaaaguuuaguuucaauuaccaccauuagcucucauguuuagauuacaaaugacuaaaaguagcuaaaaauagcugcuaaaguuuaucucgcgagauuggaacagggc

SEQ ID NO: 7914 - RNA, 88 nt, Zea mays
ggguucaacaucagaaaagauguaccucugucaggaucgugucgaugugggccugcugaccgaggacccuuuaacuggucacaucccu

SEQ ID NO: 7915 - RNA, 161 nt, Zea mays
gaagcuccgucucgcccgaccuuaggccucggccucggccucgggaggagaucuccgccucgccuaaccccggggcucggccucagccucggccucgggaagagucacguccucgcccgacccugggccucggccucagcgucagccuuggaggagucgcc

SEQ ID NO: 7916 - RNA, 77 nt, Zea mays
cgccgccgacuggcuugcgugcgcccgcgccuccgccuaacccugcuagcuugcgcgcccaacgccagaagccagau

SEQ ID NO: 7917 - RNA, 266 nt, Zea mays
aacagcaggagcugguggcacuggcggcugagugcugacggagcugaugaccggcgacgagaaaaccagggugaccggcuggagcugagaggaagaaggaccaacuguaggaagaggggguccugccugaauggcugguacaacagucgucugaagagcuggagggggugcagacugaaccgaagggaucugaacacugguaugcuaaagaacaugagucaugaaggcccggugcucagcccuaucugccaaaagcugcugcugca

SEQ ID NO: 7918 - RNA, 77 nt, Zea mays
  misc_feature (10)..(10): n is a, c, g, or u
  misc_feature (69)..(69): n is a, c, g, or u
caucgcugcnggcugucagguucugaccaaccccgcuggaugcgggcggcggccugacccugacaucgnuggcgacg

SEQ ID NO: 7919 - RNA, 153 nt, Zea mays
cauucccgccgaccaaguuuugggcucuguugauggcacugaauuggucccugcugguucauugcgagcugcuucgggugaaggagcuucgucucuugcacguuggaauccggugcugcuucagcagcgugucucugacuuggagguggcgaa

SEQ ID NO: 7920 - RNA, 75 nt, Zea mays
cagugcucuuuguggaagcguggacuguccauggcuaggggccagacgguccgcgaccuggcgcagaggcuaggg

SEQ ID NO: 7921 - RNA, 74 nt, Zea mays
agaggcucaucacauucuuggauuucugguggagaccauuucuuggucaaaaauccguagguguuagccuucga

SEQ ID NO: 7922 - RNA, 181 nt, Zea mays
gcccuguuucaaucccgcgagauaaacuuuagcagcuuuuuuuuagcuacuuuuagccauuuguaaucuaaacaggggagcuaauggugauaauuaaagcuaaacuuuagcgcuucauuucauauagcuaaaguuuagcaggaagcuaaaguuuaucccgugagauugaaacggggccuaa

SEQ ID NO: 7923 - RNA, 88 nt, Zea mays
acacuacuucgagucucauccggugacuguggugucauccuuccccccgggguugaucauccagugccgagaggccucggguaggaua

SEQ ID NO: 7924 - RNA, 82 nt, Zea mays
acgcucaucgcggcgggccccgucauggugauggcguccacguucgccaacgccaccuacgagaggcugccgcucgaagagg

SEQ ID NO: 7925 - RNA, 75 nt, Zea mays
auccaccaccgaggggcggcguauccagggagaacucaagaaucuccuggaggaugccgcgguccagcgggccga

SEQ ID NO: 7926 - RNA, 128 nt, Zea mays
caucauggagcacgcggggugccaucauuacuuguuuaccggggcgagccagaugggacgccggucuuguuccccguagccugagcuagcuaggaguaggguaaugaugcccccccugugacgugguc

SEQ ID NO: 7927 - RNA, 65 nt, Zea mays
guauuuauagguaccugagcgcgcagcgccuugagcuaaggacgcaugugcccucagcuaccuag

SEQ ID NO: 7928 - RNA, 69 nt, Zea mays
cccgcgggagcuagcuguggucccagucccugcggggggucaggacacacagcucgagcaaauccacga

SEQ ID NO: 7929 - RNA, 164 nt, Zea mays
ggggcugagagccgccgucgucacagggcaugcggggcgccaucauuacucgcaugguggagcgagccagaugggacgccggucugguuccccguagcccgagucagcucgggguaggguaaugauggcgcuuccuguugacguggucgguccaugcccuaggc

SEQ ID NO: 7930 - RNA, 73 nt, Zea mays; identical to SEQ ID NO: 6931

SEQ ID NO: 7931 - RNA, 73 nt, Zea mays
ugcaaaacguacggcugcaacuguuccgcgcaacccagaaggacuacagugaagcagcgcgguggguuaucgg

SEQ ID NO: 7932 - RNA, 188 nt, Zea mays
aacgaaugguaccucuugguugauggacgguggugaagucgcaucggggacggaaugcaccgcuaucucagguaugaggcuaacguccaacaaguccuucgcgagggugcuggcgucaucaguccgcuuggggggugccggcgucgucgacucacucugguccgacagccgacgaggugccgccuccu

SEQ ID NO: 7933 - RNA, 188 nt, Zea mays
cguuucgaccccgggggucccuggaccgacgagucgggcgaggcgaagacuccuccugaggccgaggccggggucgggcgaggacgugauuccucccgaggucgagguugaggccaagcccugggguugggcgaggcggagaccaccuuccgaggucgagguugaggccgagcccuggggucgggcga

SEQ ID NO: 7934 - RNA, 68 nt, Zea mays
uccuaugaccggucaguggagcggcgaagugacggcggucacuucggcucugucggcugaggggcgcg

SEQ ID NO: 7935 - RNA, 91 nt, Zea mays
uuaggcuccgcgguggaaucauugagcccucguugcaggcgcucgcucgcaaguacaaccaggacaagaugaucugccgcaaaugcuaugc

SEQ ID NO: 7936 - RNA, 69 nt, Zea mays
cucuuuggugucccucggaaaguuucuaacucuuagugaguugaacuaugacgagugggccgacaagaa

SEQ ID NO: 7937 - RNA, 70 nt, Zea mays
cugucuucuugucaggccggucaguggagcggcgaagugacugcggccacuucggcucugucgaugaagg

SEQ ID NO: 7938 - RNA, 216 nt, Zea mays
ugagcuggaaggagaggauggacgacuggaaguccaagcagggcauccucggcggcggcggcggcggcgaccccgaagacauggacgccgacgugccgcugaacgacgaggcgaggcagccgcugucgcgcaaggugucgaucgcgucgagcaaggugaacccguaccggauggucaucguggugcgucucgucguccucgccuucuuccuccgcu

SEQ ID NO: 7939 - RNA, 73 nt, Zea mays
aggauccaugggggagaaauccccuugcaauucaauuuugaauagcaagaggauuucuucccccagggauccc

SEQ ID NO: 7940 - RNA, 142 nt, Zea mays
uccggggccgaggccgaguccgagcccugggucgggcgaggcagaguucaucgucuuccggggccgaggccgaguccgagcccugggucgggcgaggcggagcucaucgucuuccggggccgaggccgaguccgagcccugg

SEQ ID NO: 7941 - RNA, 109 nt, Zea mays
augggucggcgcgaggccgagcgcgaaggggggagaaagguggccggagacgggcgugagagagguggaaaucccgcgaccuucguguucgucccgcgcccaggucggc

SEQ ID NO: 7942 - RNA, 114 nt, Zea mays
guuauuuuuaauccauauggauuggaggggauugauacggauugggagggauuuugacuugcuagggauugaaaccaccucaaucccccucaauccauauggauuggaguagaa

SEQ ID NO: 7943 - RNA, 95 nt, Zea mays
ccugggucgggcggagcggaguucgucgucuaccggggcugagcccaagucugagcccugggucgggcagagcggaguucgccgucuuccggggc

SEQ ID NO: 7944 - RNA, 219 nt, Zea mays
gucagcccguccucccgcgcggccaccuucucguacgagggcccuggaccuuccuuuuauagauguaaggagaaggcccagguugaguccgagcccuggggucaggcgaggcgaagaccgucuuccgaggucgagguugaguccaagcccuggggucgggcgagguggagaccgucuuccgaggccgaggcgggggccgagcccuggggucgggcgagg

SEQ ID NO: 7945 - RNA, 235 nt, Zea mays
gcugucuuauuggcaggggugguucaauagucaaugacaugaggaagaagacuaaggcaaacauccucauuucgaagggcgauaagccccggagagcaucuuccagugaugaacuuguugagguaucuggagaagcagacaagcugcgugaugcucuuguucagauaauuuuaagacuuagggaagccguucugaaagagaguguugaaagccaaaauucugacagggauggcca

SEQ ID NO: 7946 - RNA, 104 nt, Zea mays
agggcaguaggggaguggucaguguagggaggcccucgggaggauuuugcugcgauggcgguccugcaagggauuccugcauuggagcuuccuauaaacuguag

SEQ ID NO: 7947 - RNA, 69 nt, Zea mays
uaguaaagaugugacauucguuucuguaccaugauucaucauaugugugagacuuugucccaucacacc

SEQ ID NO: 7948 - RNA, 108 nt, Zea mays
gccgggucguuguaguauaguggcuggaugaugaagaaaaauaaucggauucccauugauuuuacaauaugauuuuaacaaccagcuacuucugacaaacacugagaa

SEQ ID NO: 7949 - RNA, 97 nt, Zea mays
ggguucuucaugucccgaccccuucucaguucgccgacaucuucaccaaaggucucccuacgucgguguuugaggaguuucgguccagucucaacau

SEQ ID NO: 7950 - RNA, 99 nt, Zea mays
aaggcacgccgggcgucgaccucgcguucgagacgaaggcaagcgccguccccccacgacacgcugaucucgagcaagaagacgacgccagcgcgcucg

SEQ ID NO: 7951 - RNA, 290 nt, Zea mays
cugaaaaagaugauaaacuaguugcuggcgcucuuaaccuuauuggaggugauacacuauuuggccgguuauggggaugccugccagaugcuuacuuucccaauuugcauuuugaagcuugcuauuaucaggcaauugaagcagccauagaguuaaaccugaguaagguggaggcaggugcucagggagagcacaagauccagcgugguuaccucccagugacaacuuacagcugccacuacuuuucaaauccugguuuugcggcagcuauuggaaauuaucuuacucau

SEQ ID NO: 7952 - RNA, 69 nt, Zea mays
aggaaagguggccucugcgaugccguugcauuugcuguugguguugguaucguuggugcuggauugcuu

SEQ ID NO: 7953 - RNA, 86 nt, Zea mays
auccccgaccccgacgacgacagccuguucgaccucaucaccaccagcgccgggucugaucagucgucgucgucggcucagcacuc

SEQ ID NO: 7954 - RNA, 84 nt, Zea mays
aacuuauauggacuaaaaguuucagccgaaaaccgcuucuuccuacaagaccuucggcgacgaagcauagucccaacagggucc

SEQ ID NO: 7955 - RNA, 80 nt, Zea mays
uuugcaacgauucuauuuccugucuuagauaugagaaugucauauuacaugcuaagauagaugaauuaaaugcuugcaaa

SEQ ID NO: 7956 - RNA, 73 nt, Zea mays; identical to SEQ ID NO: 7381

SEQ ID NO: 7957 - RNA, 294 nt, Zea mays
cuugcgaguauuuggcauucucguuugugucauauuaauuuuggcucuaugucucggcuuucaaccaugaguuuaauuccgaauaucaccauagucaaagguucuaagugccauaguugugugcagucgaagcaaccucgaaagccucacaaggcuacugaggagagacaccuggcaccucuagaacucauacauucugaucuuugugagaugaaugguguguugacaaaggguggcaagagauacuucaugacauugauugaugaugcgucuagauuuugcuauguauacuug

SEQ ID NO: 7958 - RNA, 72 nt, Zea mays
ggcucccaugccucaggauaacgaggguuacauuuuguacccugccggcuauccugagagcaaaauuaggag

SEQ ID NO: 7959 - RNA, 74 nt, Zea mays
auauccugcugguuuaugcauccgggggcucaaguuggaucauugauagcgggugcacaaaccacaugacauga

SEQ ID NO: 7960 - RNA, 80 nt, Zea mays
uuugcaaugauucuauuuccuaucuuagaaaugagaacgucauauuacaugcuaagauagaugaauuaaauguuugcaaa

SEQ ID NO: 7961 - RNA, 85 nt, Zea mays
agccaacguucagaagggggcaccgaacaguguccggugcacaccggacuguccggugcccccuucugaccguugguucugccac

SEQ ID NO: 7962 - RNA, 79 nt, Zea mays; identical to SEQ ID NO: 7501

SEQ ID NO: 7963 - RNA, 108 nt, Zea mays; identical to SEQ ID NO: 7421

SEQ ID NO: 7964 - RNA, 121 nt, Zea mays
cagugaguccggaccuucacgggagaguaccggaccccuggauauacaguccggacccuaagguuggucucggacccucggauauacaggucggaccuccgguguugguccugaaccucca

SEQ ID NO: 7965 - RNA, 72 nt, Zea mays; identical to SEQ ID NO: 6942

SEQ ID NO: 7966 - RNA, 73 nt, Zea mays
aggcuuccaugccucaggauaacgaggguuacaucuuguacccugccggcuauccugagagcaaaauuagaaa

SEQ ID NO: 7967 - RNA, 70 nt, Zea mays
uucucacgaagccacuuccacgcguacgacuccaggccagagcuacgcguccgaagugguguuuucaucu

SEQ ID NO: 7968 - RNA, 87 nt, Zea mays
ugacauuguagcuguugggcagggaaggccuggaucauguaauugccccuacccaggauccuuccucugcagacagcuccacacaaa

SEQ ID NO: 7969 - RNA, 59 nt, Zea mays
agcuggaccaugcauuagaugagcugaguagggcucgugcugagaucgcccagcugcgg

SEQ ID NO: 7970 - RNA, 73 nt, Zea mays; identical to SEQ ID NO: 6704

SEQ ID NO: 7971 - RNA, 98 nt, Zea mays
ucccuuggcgacggcaaggaacccgacgacggcgaccgaggccaccugcagggcagccucgagcgccgcguugcagcuccugcacuguaccacaugcg

SEQ ID NO: 7972 - RNA, 152 nt, Zea mays
augacgaggacgcagccaugaccaucacgcgcuggcuucgugccccugauggcgggguucucggcgccgacgcgagcgacgacgguugcggugaugccgguggcuucuucuugcacuugcugccgugguggucguggucgugccuccugcug

SEQ ID NO: 7973 - RNA, 128 nt, Zea mays
ccggacauguccggugcacaccggacaguguccggugcuccagaggacagcggcucugaacucgccagcuucgagaauccgcuccgcuauaauucaccggacauguccggugcacacuggaauguccg

SEQ ID NO: 7974 - RNA, 128 nt, Zea mays
gucccguucgucuucccugccuucguccuguucuuccaccccaaccugcuacccgcccacggucgcagccacgagccgaccgacggucgucgacgcggguccagggcugggaagacacucgcauucuc

SEQ ID NO: 7975 - RNA, 95 nt, Zea mays
gaucgccacgccaaccgaccguaucgcaggagcauuuaaugcaagggucgacugacaccuuauccuggcgcgugcuccucaguugacagagccga

SEQ ID NO: 7976 - RNA, 418 nt, Zea mays
guucgccugugugaccuucgucgcucgcucccacagcaauagcaaggagaaguuggucuuccugcaacccugcuccagccccaaucccgucacguuguugaagccguucagcuacaaggaggcguccguucagaagcaggacaagaaggaaagggaggccugggcacgugagacgaagcccccgaugcuccaaggacaaggggccaaggacgguccaaccguccaagcaggccaaagacggggaaagcagaccaaggauggguccugugucgcgccaaggcgacgaccaagccgacgugggguuguaucggcgccaaacguuaccucaaggaguugcaucggcaccaaacgggcgagaguccauggcggcggcgaaccagcugcgcgugggagaggaacggcggugggcugcgcguga

SEQ ID NO: 7977 - RNA, 72 nt, Zea mays
gaccugggcugacgacugccaguuucaucuggaggcgaugcagcugggaaaggcgaucguucggcuaggccc

SEQ ID NO: 7978 - RNA, 91 nt, Zea mays
agcggagaagaagacuucuuguauugucucccagacagcaaggagaucucugucugccgggagauggcaagaagcuucggauucucaacac

SEQ ID NO: 7979 - RNA, 72 nt, Zea mays
ugcugagagccgcacucggcaaaguccugcucucaguaacgagcugguuuaccgagugcaggacacucggca

SEQ ID NO: 7980 - RNA, 72 nt, Zea mays
ugacacccgcgagcggcgucacgagugaugggucuagcuauccaucccuccgacuccggcuccuccgaaagc

SEQ ID NO: 7981 - RNA, 232 nt, Zea mays
cgccgucaacugcaagaauccucggacgaaguggcccaccuuacacaguugcuaucggcaaaggacgccaccaucaagggacuccgagcuucuaagaaauccauugcucaggaguuagaaacugcucagcaggcuguuaaaguugcugaagaagcugcugucacuuucaaagcucagcgcgauaaggcccuggacaaggccauucgagcgggacgaaucuugaugagaagac

SEQ ID NO: 7982 - RNA, 67 nt, Zea mays
ugauuugggggucccuucguucuuuucaaaccuccaggcuuugguggaugggauggccagccagcug

SEQ ID NO: 7983 - RNA, 232 nt, Zea mays
cgccgucaacugcaagaauccucggacgaaguggcccgccuuacacaguugcuaucggcaaaggacgccaccaucaagggacuccgaguuuccaagaaauccauugcucaggaauuagaaacugcucagcaggcuguuaaaguugcugaagaagcugcugucacuuucaaagcucagcgcgauaaggcccuggacaaggccauucgggcgggacgaaucuugaugagaagac

SEQ ID NO: 7984 - RNA, 232 nt, Zea mays
uugugaugaagagcggcaaguacacccugggcuacaagaccguccucaagacgcugcgcaacuccaagggaaagcugaucaucaucgcaaacaacugcccuccacuuaggaagucugagauugaguacuacgccaugcuggccaaaguuagcgugcaccauuuccacggaaacaauguugaucuuggcacugccugcggcaaguacuacagggugugcugccucaguaucau

SEQ ID NO: 7985 - RNA, 143 nt, Zea mays
guuauaucaugugucaucaaaggauuucugguccacaauguucugguugacacaggcagugcagcggacaucauauuugcaaaggcuuuuaggcagaugcaagagccagaggacaaaauucaugaugcuacacacccuuuuug

SEQ ID NO: 7986 - RNA, 164 nt, Zea mays
guagcuaguugauacgcgauuguuuuggaugaaauuuggaucuguuccaaugcaaugauaaugcaugugugaugagguccuucggagcgcaucgcaacaggcgaaaucguugcuuuggaagagauccaaguuucauccgaaccagucgugugucgaggagguaa

SEQ ID NO: 7987 - RNA, 84 nt, Zea mays
cuccuaaguuauugggcccacaugcaccuguccuugucucaaagaccucagacugcuaugucugugcaccagcuaacuuaacag

SEQ ID NO: 7988 - RNA, 71 nt, Zea mays
agugaacggaacggagcgugacuaugcgagcgggcugggaaaggagcggcuccguccgguugauuuuuugg

SEQ ID NO: 7989 - RNA, 70 nt, Zea mays
acgauuuuuucgagaagcagacgcgcgaugcccacgcgggcaccgccgccaucccuucucuuccuucgga

SEQ ID NO: 7990 - RNA, 84 nt, Zea mays
acuuuguaggauggcguuucuacuuguuggacccucacuaugacgagcaccacaguggacaacucaccacagaggggagguaau

SEQ ID NO: 7991 - RNA, 218 nt, Zea mays
ccaaaccaaacaagggggagcucagugacgaggugaaggauaaacugaagucagacuaugaccaaguuguaacggaaguugcugaggcuacaucugcaauguucuaaggaccauucagggaccacaucaccugagaaucaugcagcucgcugugcgcauucuuuggcguacuauguaaccugauccuugucagucugugcccugcuugcgugaaccgc

SEQ ID NO: 7992 - RNA, 89 nt, Zea mays
uccggugcaccaccggacagguccuguagacggucugggcgacaaguucgccgcggaugacucaucggacaguucggugcaccaccgga

SEQ ID NO: 7993 - RNA, 123 nt, Zea mays
ugugagagcuugaagcugccagcaugaucuggcugcucaaacgccgccggccucccaagugcucgcucgaucgucgguggcgcuuggauucaccagaucauguugcagcuucacucucucgca

SEQ ID NO: 7994 - RNA, 66 nt, Zea mays; identical to SEQ ID NO: 7023

SEQ ID NO: 7995 - RNA, 119 nt, Zea mays
gaaugagguauggcauuugguuccacguccuaaccaaaauguuguagguaccaaauggguauucugcaacaagcaagacaagcaugguguggugacaaggaacaaagcccgacuugugg

SEQ ID NO: 7996 - RNA, 69 nt, Zea mays
ugaagguagacccgguuuauggcguggcaagccguguucacggcuuccgaccaaaaccgcucgggcguc

SEQ ID NO: 7997 - RNA, 72 nt, Zea mays; identical to SEQ ID NO: 7427

SEQ ID NO: 7998 - RNA, 81 nt, Zea mays
uagcauuuaagggaguguuagagggucagcuauacuuaguagauuuugauagagcugaacucgacacaugcuuaauugcua

SEQ ID NO: 7999 - RNA, 215 nt, Zea mays
ugcggcucguugaucggaccauucaaggcgucguccacguaucuugccuccuugaucaucauucgcccgcuaacgaauuucccaaguacuucuucgggcgacaucuugguguaccuaggauuuucacgaauauuguucaccaaaugaggaucaagaacgguaaaggaccuuagcauuaggcggacgacgucgugauccguccaucgcgugcuucc

SEQ ID NO: 8000 - RNA, 79 nt, Zea mays
gauuuugggcugucuaaggcucagagcgaguuagauaaaaaaauaugggcagauucugagauugggcagauucugagcu

SEQ ID NO: 8001 - RNA, 64 nt, Zea mays
uaugcuaugacuaauguguuuucaagucuauuucaaaccaagucauagguguauugaaagggaa

SEQ ID NO: 8002 - RNA, 82 nt, Zea mays
cggacucucuccugaucuagcacacuuggaugagauaaagaacuugcagcguccaacugauguaccagaucaaggucuacug

SEQ ID NO: 8003 - RNA, 60 nt, Zea mays
caacagacugcucggucugggugcaccggacuguucggugcgccaggcuggcgucuguca

SEQ ID NO: 8004 - RNA, 101 nt, Zea mays
aacaugucuggugugcaccgaauugucuacucagagagccccaccaacggacucucgggagcuauagcaucggacuguccggugugcaccgaacagucugg

SEQ ID NO: 8005 - RNA, 98 nt, Zea mays
aucccaaaaccauagggauugagggggauuggaagggauuggagaggauuuugacuuauaggggauuuaaucccccucagucccuauggauuaguaca

SEQ ID NO: 8006 - RNA, 61 nt, Zea mays
ccaggcaaauacccgcuccucgucgauccggugauccgagagagccggguaaagaagguac

SEQ ID NO: 8007 - RNA, 99 nt, Zea mays
gaaggcgccaacuaccuccgaggagcuguuccgggaagccgaccucuacaucaccgccgaugagcgagcccaggaccucaucggaggagcgaagcccgc

SEQ ID NO: 8008 - RNA, 73 nt, Zea mays
auugacgagcucgacgaagucauagcugggcauggugauuucugugccuggguagcuucucgggggacugcug

SEQ ID NO: 8009 - RNA, 256 nt, Zea mays
gacaagaaauccaauggcaaguggaggauguguauugaacucacagaucuuaacaaagcguguccgaaggaugaauccccacuaccaagaaucgauucucugguagacgcagcugcaacuucggagcucaugagucuguuggauugcuacucaggguaccaucaaaucuggauggaaaaagaagaugagaugaagaccacuuuuauaaccccaguggcacuuacugcuaucuucggaugccugaggggcucaaaaa

SEQ ID NO: 8010 - RNA, 72 nt, Zea mays
auccggaccgacggcgagcucgugcgccugcugcccaagugcgcgcacgcguuccacguccccugcaucgac

SEQ ID NO: 8011 - RNA, 73 nt, Zea mays; identical to SEQ ID NO: 7057

SEQ ID NO: 8012 - RNA, 125 nt, Zea mays
ucuggcuggugcugugcuugcuuguugguuaccucguggaagcuuaaaauaucucgucuuguugacauccuugcaguugucgcgugaacaaguaaucuaugauggcaauguuugccuggucauga

SEQ ID NO: 8013 - RNA, 185 nt, Zea mays; identical to SEQ ID NO: 6739

SEQ ID NO: 8014 - RNA, 73 nt, Zea mays
ccgaccguuggagcuggccacgugucgcacauugaucgcguggacgaccguuggccgcuggcgcaguuggcuu

SEQ ID NO: 8015 - RNA, 103 nt, Zea mays
cucaauccauguggauugagugagauuggaugaguuugaaucccaaacaagucaaacuucuccuuaauuuuuuccaaucucauccaauccauguguauuagga

SEQ ID NO: 8016 - RNA, 74 nt, Zea mays
ccaagaucguccucgccggacuucggucgcccgcggccgcgcguagaccgagcaauccggcuggauuccuugcc

SEQ ID NO: 8017 - RNA, 178 nt, Zea mays
ggggccuggucgggccguccacuggcgggaucgacgccggagucgaguugccgaggccacgagccgggcugcuguccucagggaacagcuggcugaggcuucggggcggccggccgagccgucugcucggcccggauuccuggagaagacccuggcggcgauggcccgggcgcggugc

SEQ ID NO: 8018 - RNA, 170 nt, Zea mays
caagggaaggguuuacuauucauucgcccgggggacaaauauuuacuaaagaaguggcuuaccaagugccuguaacauuggcuaaacgggacuuuccaacaaacaugauuguucuaaaaggccaagacauagauguaauuuugggcaugaauugguuagcccagcauaaa

SEQ ID NO: 8019 - RNA, 63 nt, Zea mays; identical to SEQ ID NO: 6721

SEQ ID NO: 8020 - RNA, 84 nt, Zea mays
uguuagggaucggcgucaagauguauggugcugacccccugacacgagaugccagcgccaagaucuauggcgccaaccccugcc

SEQ ID NO: 8021 - RNA, 60 nt, Zea mays
aggacgugacuuacaaccaaugagguaaaagcuacagucaugugguguaagucauaaggc

SEQ ID NO: 8022 - RNA, 82 nt, Zea mays
uggacucucuccugaucuagcacacuuggaugagauaaagaacuugcagcguccaacugauguaccagaucaaggucuacug

SEQ ID NO: 8023 - RNA, 77 nt, Zea mays; identical to SEQ ID NO: 6722

SEQ ID NO: 8024 - RNA, 88 nt, Zea mays
uuaugacucaaacacaagggcauauagagucuucaacaaauccacuggauuaguugaaguuucuugugacauuguguuugaugagacu

SEQ ID NO: 8025 - RNA, 73 nt, Zea mays
aagcucccaugccucaggauaacgaggguuacauuuuauacccugccggcuauccugagagcaaaauuaggaa

SEQ ID NO: 8026 - RNA, 88 nt, Zea mays
uuaugauucaaacacaagggcauauagagucuuuaacaaguccacuggacuaguugaaguuucuugugacauuguguuugaugagacu

SEQ ID NO: 8027 - RNA, 75 nt, Zea mays
cccuauuaagccugaagagguaguccuugggcaauacgauggcuacaaggaugacccuacagugccagaugacuc

SEQ ID NO: 8028 - RNA, 70 nt, Zea mays
cauagaacugggccaugucgggcucggaucggacccaaacaacggguuucgugccgggcucacgggccuc

SEQ ID NO: 8029 - RNA, 127 nt, Zea mays
gcaaggggcggugacgagcuagaggcagcaacugcauaucuugcaagaaaauugguuuucgaaccauaccgauaauuuucuugcaaguugugcaguuguugucucaagcuugcugccucccuuugcc

SEQ ID NO: 8030 - RNA, 127 nt, Zea mays
gcagggggcggugacgagcuagaggcagcaacugcauaucuugcaagaaaauugguuuucgaaccauaccgauaauuuucuugcaaguugugcaguuguugucucaagcuugcugccucccuuugcc

SEQ ID NO: 8031 - RNA, 205 nt, Zea mays; identical to SEQ ID NO: 6907

SEQ ID NO: 8032 - RNA, 64 nt, Zea mays
gacggggauggccggaaucgcucgguccacggaguccggcgaccgugaacuggccucuccggcg

SEQ ID NO: 8033 - RNA, 75 nt, Zea mays
cguaccaucuuggcacugagccgcuucagggccucgaaguuaaggugcccaaagcgcuugugccacugccaugcc

SEQ ID NO: 8034 - RNA, 67 nt, Zea mays
caaaguucaguauggcgcaccggacacugucuggugcaccaccggacaguccggugugccagacuga

SEQ ID NO: 8035 - RNA, 88 nt, Zea mays
ucuucaccgcgcucgccgccgccugcgucgcuaccuacgccgucgccguaucgcgcgacccgggccgcgugccagcguccuucgugcc

SEQ ID NO: 8036 - RNA, 462 nt, Zea mays
gauaucagagcuuuuugucgcgcacuuggugaacaccacucuugcuagcuucgucuucacucgauucuuagaauuucuugcugacgcguugaacgacgaugagaucguguucgaggaacuucgacgaacacgaaggggcucaggcgggaucgacggcgcggacagcgagcaggcgauucgauggcgaguagagagcugggcgagcagcgaggucgacggcgaacgacgcgacgacgaacugggauaccagggagacccgagggcgcgcagggagauccggcuggggcagagggagcuuuacgacgagcucagaacaaaggagugccgcacagaggaacuuggggaggccgcggcgcuggggaagaaacugagcucgcacgcaggggaacuuggagaaccacgcggggccagggaaauggguaggagcgaccggacauggagggauagggagcucaacgagcu

SEQ ID NO: 8037 - RNA, 83 nt, Zea mays
uaacagauguuguccuugaaccagacuugacauacucggaacauccuauucgaguucuggaucaaaaggacaggaucacccga

SEQ ID NO: 8038 - RNA, 220 nt, Zea mays
agagugggcagcugagaauuaugcagauugggaggaacuuuauaaccguaguaugugaucuaggaaaacuauaaagugucaugagaaguacuauugcuguaguaccugauccaaguugugaggacuucuauuauguuguaguaugugcuugugcuucuaguuguggugacuucuauuauguuguacuaccuccguucucgaauauuuaucgcccgcuauu

SEQ ID NO: 8039 - RNA, 96 nt, Zea mays
ugugcacgcgguuguagggagggcguauuguggcggcuacgagggaccgauguuccuguguggcggugacaacgacaccguggagccaaggcaaua

SEQ ID NO: 8040 - RNA, 172 nt, Zea mays
ccggcggucgggcgaaguccggcgaccguggacuggcuucuccggcgaagcaaaguccgauuccuugcucggggagcuucaccgaggcaugcacggucucuuccaagggucgggcguggcugggaagggcucuguuggccggucuacgguggcaggggcucggguggccgcg

SEQ ID NO: 8041 - RNA, 103 nt, Zea mays
uuugaagguuugacagaagagagugagcacacacggugguuucuuaccaugagugucaugcuaggagcugugcgugcucacucucuaucugucagccacucau

SEQ ID NO: 8042 - RNA, 103 nt, Zea mays; identical to SEQ ID NO: 8041

SEQ ID NO: 8043 - RNA, 67 nt, Zea mays
ggcgaagaagcaggacagcgucgaugccgcggcgagcgacgucggcagcugcgugucgcucucacuc

SEQ ID NO: 8044 - RNA, 84 nt, Zea mays
ggcugccucgcgcgucuguauggagcauguauuugacuccaguucaaaaaaggaugcaaagcucaggcuaccgcaggccugcac

SEQ ID NO: 8045 - RNA, 79 nt, Zea mays
uuagcggcugggugggugcuucucccggaccauuagaauguugcuucgggucgaagcgcuugcuccagaagccggauga

SEQ ID NO: 8046 - RNA, 84 nt, Zea mays
cacggccguggccgccgcuccguaccguguggcauugcgcugcagcagccacaugagccccaugagcucgcagucacggucacu

SEQ ID NO: 8047 - RNA, 144 nt, Zea mays
guauguugcguuggauaugugggcacacaagauuggauagagugagaaacgaugacauaugugaucggauaggaguagcacuaauugaagaaaaagcuuauucaacaccgguugagaugguuugugcauguccaccggagaccc

SEQ ID NO: 8048 - RNA, 88 nt, Zea mays
accuuauccugacacgcgugccucagucggcaaggucgaagugaccgcagucacuuugcccuuucacugagcgaccugacaggaaaac

SEQ ID NO: 8049 - RNA, 93 nt, Zea mays
ugggagccaggccgaugagcucgacacgcugggggugacgacgcccgccgucgaccagccccgcguugucgaaguccgggccgcccgcggggc

SEQ ID NO: 8050 - RNA, 133 nt, Zea mays
uaagcauaugccugguacgacguauugccccaucccuucuagcguuggucggcagccccgccucaccggguugcucggcaguauucguucagcagguggguuggucagcaauccugucucacugggucgcuag

SEQ ID NO: 8051 - RNA, 70 nt, Zea mays
augcccggugcucggcccaggcacggcacuacccaucgggucgugccgugcuccggacuggcccgauuag

SEQ ID NO: 8052 - RNA, 69 nt, Zea mays
ccuggugauuauguucgcgcccgggucuuagugccccugaaaacccgggugugacacguaugccagcca

SEQ ID NO: 8053 - RNA, 71 nt, Zea mays; identical to SEQ ID NO: 7867

SEQ ID NO: 8054 - RNA, 83 nt, Zea mays
augggcggguccggugccaccacguguccagagaaagugacauacucugagguaucaccagugaguccggaccccaaugggaa

SEQ ID NO: 8055 - RNA, 124 nt, Zea mays
  misc_feature (15)..(15): n is a, c, g, or u
  misc_feature (52)..(52): n is a, c, g, or u
  misc_feature (57)..(57): n is a, c, g, or u
  misc_feature (117)..(117): n is a, c, g, or u
uugcuucugaguggnauggugucugggucaagggcuuuugcuuugugauccnucugnggagagcuucuaaguauuccuuggaucugcaagaucucggaccaggcuucauuccccucngaaauag

SEQ ID NO: 8056 - RNA, 76 nt, Zea mays
agacaguucagucugggugcaccggacuguccgguggugcaccggacagugaccagugcgacaggcuggcucuggc

SEQ ID NO: 8057 - RNA, 68 nt, Zea mays
cacggcgccuguggcacaccggacagucugguggcccaccggacaguccggugcggccuaguaaccgu

SEQ ID NO: 8058 - RNA, 76 nt, Zea mays
uagguucucugaaaugaccaggggcaucggaggaagaauccacccgaggcacguuaggucaauucacaacucaacc

SEQ ID NO: 8059 - RNA, 66 nt, Zea mays
aaaacaaguagaagaucgagcaacaagcuaguaauuuaccaagguguugcucucucuacuaucuau

SEQ ID NO: 8060 - RNA, 108 nt, Zea mays
augggucggcgcgaggccgagcgcgaaggggggagaaagguggccggugacgggcgugagagagguggaaauccgcggccuucguguucgucccgcgcccaggucaga

SEQ ID NO: 8061 - RNA, 61 nt, Zea mays
acgccacuuggccgacacggccgcggcucccgcugcugcuggugucgucccuggccucccc

SEQ ID NO: 8062 - RNA, 183 nt, Zea mays
guguacuaccucgcugaugagcucggggugcacuucguuuggcagcucagccaagagucaucgguacucuccaugucgugcgcguucgacgacuacuauaucaaggacuauggcgucaucuuggcgccagagguggcgcagagaaggaccgacagcauugaccacucgccaucgucgggguag

SEQ ID NO: 8063 - RNA, 67 nt, Zea mays
agcucaaaccugaugccagggguccagugcuguguuuuguuggaccaccugguguugggaagacuuc

SEQ ID NO: 8064 - RNA, 77 nt, Zea mays
ucagguuaucugaaaugaccagggguuucggaggaagauuucacccgaggcacguuaggucaauucauaacucugcu

SEQ ID NO: 8065 - RNA, 76 nt, Zea mays; identical to SEQ ID NO: 7756

SEQ ID NO: 8066 - RNA, 272 nt, Zea mays
aucaagaacaacugccugaucgguggugacgacuucaagagugggcagaccaagaugaaaucgguccugguugauuuccuuguuggugcuggaauaaagcccaccucaauugugagcuacaaccacuugggaaacaacgaugucaugaaccugucugccccucaaacauucagguccaaggagaucuccaagagcaacgugguggaugacauggucucaagcaaugccauucucuaugggcccggcgagcaucccgaucauguuguugucau

SEQ ID NO: 8067 - RNA, 132 nt, Zea mays
uugcgaggagccgcggcggccgggacggacaggcgggagggggacgucgcgaggugcggcggcgccauguccgacaccacgcucuaccuccuccucgaccgguucgcgcccagcugagcgggccccuugcuc

SEQ ID NO: 8068 - RNA, 97 nt, Zea mays
cucauaaugaugcuauggucauaucuugugucaucaagggauuucugguccacaauguuuugguugauacaggcaguguagcugacaucauauuugc

SEQ ID NO: 8069 - RNA, 72 nt, Zea mays
aaaaaagccgagucugucccugaucgcccucucgcccugugcagaggcucgggggcugcucucgcaaacccg

SEQ ID NO: 8070 - RNA, 95 nt, Zea mays
auggaaauggcugaaggcccgucaaccuuagaggugguuacuguagagagccaggaccucaagaauggugcugacgcaugcccagcccccgagga

SEQ ID NO: 8071 - RNA, 70 nt, Zea mays
ccaugggggugaacugggugauggugauugugcaccagcgucggcguuaucaagcagugcaaaguauagc

SEQ ID NO: 8072 - RNA, 131 nt, Zea mays
ugcacuugauggaucucauauuauggcaacaccuccaccagaagaucucauuagguacauuagaagaagugguaaagcaacucaaaauguucuugcuguaguugauuuugauaugagauucauauaugcuu

SEQ ID NO: 8073 - RNA, 112 nt, Zea mays
gagauggcccggggccuggauggaagagugguuuuaugugaagaaugaucugaagaugagagaacacauaaaagaaaucaucaugcgccccaucuggucccgcuucggccuu

SEQ ID NO: 8074 - RNA, 70 nt, Zea mays
uuguauaagggucggguaugauaucgggucggguauuaucagacccgaacacaacccgacccgcugccau

SEQ ID NO: 8075 - RNA, 73 nt, Zea mays
cucagcucagucuggcacaccggacuguccgguggugcaccggacaguguccggugcgccaggcugaacuccg

SEQ ID NO: 8076 - RNA, 63 nt, Zea mays
cgcagggaaggccgccgguuuccgcaccgucaucguggggagcucggcgcuggugccaggggc

SEQ ID NO: 8077 - RNA, 77 nt, Zea mays
gcuguuucggucuggggcaccggacuguccgguggugcaccggacaguguccggugcgccaggcugccucgaccuga

SEQ ID NO: 8078 - RNA, 149 nt, Zea mays
ccgcgccacgcucgguucggugguugcguuugcgagggauggaggaagaucuacaggccgcauagggcccaccuaccagcgauggacgagucacgcgcacguacaugggauugacaacacgggaccaccguucauugagccaaucacgc

SEQ ID NO: 8079 - RNA, 79 nt, Zea mays
ccaugcugcaguugauaaccauggcgucgauguggggugcgcugcacaggucgacgucucgggcgucgaaggucaaugg

SEQ ID NO: 8080 - RNA, 342 nt, Zea mays
uuucccagccgccauucugcgaucugcaugguucgccuguucugauuuuuccugcugcgaucugcgcuucugcgaucggccgucagauggauagaagauggguuuaugggaaacaauucacaccugcauaugugaaaggaguugaagaguucaugaauuuuguuacugaaagauacccagaagacacacacauucguuguccgugcgugaauugucuuaaucaaagguugcgaccucagagugaaguagaaacucauauacacauuuauggaaugucagcuacauacacgagguggauucaucauggggagucggcagauacagaaguugaggguauagagg

SEQ ID NO: 8081 - RNA, 88 nt, Zea mays
acacuauuucgagucucauccggugacuguggugucaucuuucccucuaggggagaucauccagugccgagaggccucggguaggaua

SEQ ID NO: 8082 - RNA, 71 nt, Zea mays
aagcucgaggcgccaaugcaaucgcugaaccaaaucccuuugguuaccgaccuugcuggugccagaucagc

SEQ ID NO: 8083 - RNA, 82 nt, Zea mays
gaaaaaauucgagguucgcgagccggaucgagcuugcuaagacucggcucggcucgaaaagacucgugagcccgaacgaguc

SEQ ID NO: 8084 - RNA, 130 nt, Zea mays
gcaacaccugggcaccgguaaagcuucuuugacgaguguuguggcucuggcacucggcaaaaaagcaagcuuugccgagugccuccuagagcacucgacaaagaaccugacaaagggccccacuggugga

SEQ ID NO: 8085 - RNA, 95 nt, Zea mays
cucccucccuuggcuggagccuggagccgacggagcagaacgacgguuccuugcggcggcagcgaccucgagcugagggcggcgagaaggcggga

SEQ ID NO: 8086 - RNA, 90 nt, Zea mays; identical to SEQ ID NO: 7070

SEQ ID NO: 8087 - RNA, 80 nt, Zea mays
cccuccguggacgggcgauuuugcgcggcgacgcggcggcggaucugccgucgcccggugaagucagccccggcaccccu

SEQ ID NO: 8088 - RNA, 125 nt, Zea mays; identical to SEQ ID NO: 6831

SEQ ID NO: 8089 - RNA, 75 nt, Zea mays
agagauggcgagaguaucguguauccaccuggcaagaggcuggauggugggguacugugcucucgguuggcgggg

SEQ ID NO: 8090 - RNA, 129 nt, Zea mays
caucaugugccggaagcagccuggcaucgcgauuggccgccuuugcgagaaaugugauggcaaguguguugucugcgacucguacgugcgcccauguacgcuuguccgggucugcgacgagugcaauua

SEQ ID NO: 8091 - RNA, 125 nt, Zea mays
uauggcuggugcugugcuugcuuguugguuaccucgugaaagcuuaaaauaucucgucuuguugacauccuugcaguuguggcgugaacaaguaaucuaugauggcaauguuugccuggucauga

SEQ ID NO: 8092 - RNA, 271 nt, Zea mays
agcuacaagguucuauugaugacccaugaugucauggagaguggagguaagacccaucuaaggugccaucuagcugguuugucaggagauggcaagucaugccugaauguaccuagggaaaaaaggagggcaaaaucuaaagagcauaaacucuuuguggauaaggcaauuauggaucuagcauaugguggugcuagaagagaacaaauaccuagggaugaagcuggacagauggcgugggcacuaagggaaucauuguuggaucaaagga

SEQ ID NO: 8093 - RNA, 89 nt, Zea mays
acacuacuuugagucucauccggugacuguggugucauccuucccccuggggggggaucauccagugccgagaggccucggguaggaua

SEQ ID NO: 8094 - RNA, 103 nt, Zea mays
aggaggcacguuugcgcgcccgccgcggagggucgaggcccggaucgacguggcgcggaggcgggcuguaauccccgcgguggcugcucugcuucuggagacg

SEQ ID NO: 8095 - RNA, 66 nt, Zea mays
cggugcggggcuacgggccagcgacgccgucgucgucgucgguggcgcugccucggccgcgaucgc

SEQ ID NO: 8096 - RNA, 238 nt, Zea mays
gccgccgccauggcgaggugggucugcggcggcuccggucggugcaggcggccgcccuucaucgacggcgagcggggaacuggguggacaccgggacacguaaucguggauucgaugggagaggggaugggaggaagcagcggagggugaggaggcgucauuggauccgcugcgggacggugugcgagaccggcgccaaggcggacgccgccgcggacgcgugcgguguggcggugcu

SEQ ID NO: 8097 - RNA, 69 nt, Zea mays
ccugccccugcggccgcucugcaucuucggagguacccgcagauguagaugaauggccguaaaaugguu

SEQ ID NO: 8098 - RNA, 62 nt, Zea mays; identical to SEQ ID NO: 7446

SEQ ID NO: 8099 - RNA, 85 nt, Zea mays
gaagccaagaacuuaacaagccauagggcucccguucucaacaaggagaaaggaaaggccccuaugacuaguaguucucaaagga

SEQ ID NO: 8100 - RNA, 100 nt, Zea mays
gucgaccuagccucggacggcgacgcgguccgaagcucuccacuccgaaggagacgucaucaccacgcccgggccaucgccgccagggucuucuccggga

SEQ ID NO: 8101 - RNA, 139 nt, Zea mays
cguuucggguuuguuguuccccaucuguguuuuugauugcaaggucgcucugugucaguuguuagugcuguguucauccugggcuccagcagacccaugcaucaaacagcauggacugcggaucgauggaugcuguuac

SEQ ID NO: 8102 - RNA, 147 nt, Zea mays
agcagaucagucagugcaaucccuuuggaauucuccacuuagcgccuccauccccgcgccgcccuccagguuucgccccgccgggaugccgccuacuagcaggaagcuaguggaggacuccuaagggaucgcauugaucuaaccugc

SEQ ID NO: 8103 - RNA, 85 nt, Zea mays; identical to SEQ ID NO: 7028

SEQ ID NO: 8104 - RNA, 103 nt, Zea mays
ugcccgcuugcucaagugccuaagcauccaacgauuuucucuuaacaaagaggaagagccuauacuauggggguguuugaaugcacuagagcuaauaguuggu

SEQ ID NO: 8105 - RNA, 58 nt, Zea mays
ggagagaaaaccccaguucaacugcccggaggcaaguucagcugguguauggucaaag

SEQ ID NO: 8106 - RNA, 77 nt, Zea mays
uuguuaugcccaucggguauggugggcguggguauguucucuguugccccauacccgcuacccgauggggaacccgc

SEQ ID NO: 8107 - RNA, 121 nt, Zea mays
cgcuuuggagcggccugcucuuuggcuuugaugguugguucgcgucccuugagcgggaacgcgaacgagagccuucugguggccgcguccguccugggaccauggcugcugcugcagaggu

SEQ ID NO: 8108 - RNA, 73 nt, Zea mays
acacaacgauacucgaucgaccaggugugccggucgaaagccuggcgcaacaaggugucgagugcgucaugga

SEQ ID NO: 8109 - RNA, 149 nt, Zea mays
uggaagccgcacucagggcugauuuggugaucagggaucucgauaggaucaauggggagaaaucccuuugcuauuuaaauuugguggguuacuccuucauggaucuacgagaaucccugaucaccaaaucagcacuuaguggauuuuag

SEQ ID NO: 8110 - RNA, 75 nt, Zea mays
aauugcaaucgcgaucagaacgcugcuggacgugacgacgaugucagucgcggaucugguagggcgauugaagga

SEQ ID NO: 8111 - RNA, 75 nt, Zea mays; identical to SEQ ID NO: 7059

SEQ ID NO: 8112 - RNA, 84 nt, Zea mays
cugcuagcuggagacgagacgagggcgagaggcaguugcaucauccgccauccgcuaucguuuugucucuccuauaucuaguag

SEQ ID NO: 8113 - RNA, 67 nt, Zea mays
cacgggcccgacgccaccgacgccuggcuguggaagcuugccaaggcgcacguggugacccacgaca

SEQ ID NO: 8114 - RNA, 78 nt, Zea mays
uagcaauuaagcaugugucgaguucagcucuaucaaaaucuaccaaguauagcugacccucuagcacacccuuaaaug

SEQ ID NO: 8115 - RNA, 61 nt, Zea mays
gcacuguucacuguccggugagugccacuccgguggugcaccggacaguccaaugaauuuu

SEQ ID NO: 8116 - RNA, 107 nt, Zea mays
gcaacauuggaggagcugauccaccgccgaucaacgacgggaaccaaucuccucgacaacagcagggagaucgagaaggaggaggaggcgggucuucgcugcaagac

SEQ ID NO: 8117 - RNA, 71 nt, Zea mays
augggcgggggccuucuggcagcagcacccgcccugaggucagugcugccgcuguucggccccccggagca

SEQ ID NO: 8118 - RNA, 166 nt, Zea mays
accaucacagcuagcauuggcauggguucaccaucagggaaacgauguuugccccauaccuggaacaacaaaaaucgagaacuucaaccagaacgugggggcgcuuuucugugaaguugacaccagaugagauggccgaacucgaguccugugcugcugcagguaa

SEQ ID NO: 8119 - RNA, 143 nt, Zea mays
cggaugggggcaccagacuguccggugcgccaaccagcccaaagauccaacggucggcuacgccaggaauggaaggagauccgcaccggacaugcuacaguggcuguccgguggugcaccggacuguccggugcgccacccga

SEQ ID NO: 8120 - RNA, 66 nt, Zea mays
ggaggaggacgggguugauguugggcagcacaccgccgugcgcgauggugaccccgcccagcagcu

SEQ ID NO: 8121 - RNA, 69 nt, Zea mays
acgaucuucgugaucaggccgaucucgcaucagcaagcugaccgagacgccagugauuacuggaaaaau

SEQ ID NO: 8122 - RNA, 105 nt, Zea mays
ccuggugcauagcugcucguuagguuucgccagucguacaaauguaguacaccucccuaaggugggugacuagcaaaaccaaaucgaaaguaccucugcacccca

SEQ ID NO: 8123 - RNA, 83 nt, Zea mays
cggagaagaagacuucuuguauugucucccugacagcaaggagauuucugucugucgggagaugagcaagagcuucauauucc

SEQ ID NO: 8124 - RNA, 86 nt, Zea mays
ugucugguuuugggucaaguagacucggucuuugagcacccgucaugcugcagcucgaggacgagcugcuuguccaggaggggugu

SEQ ID NO: 8125 - RNA, 459 nt, Zea mays
gaugagcuacgaagcaacaguaucuucguaugguggcaauacugcagucauggcaaaaucuuuuguuauggcugucaggaguguugcucaaaccugguauuccucccuucgaccaggaacgaucacuucauggcaaaagcugaaggacauguuguuaaccagcuuccaaggguuucagacgaagccggucacugcucaagcccuauuccaguguacccaggaucacgaagaauaccuucaggcguauguccggagguucuugcguuugagagcacaggcaccaacagugcccaacgaaauugucauugaggccaugaucaagggacuucggccaggaccuucagcucaguacuuugcuaggaagccuccucaaacuuuggagaagcagaggcgccagggcuucggcgaaagauuuggagaucaaccaaggagaauauuuugcuuguuuuguggugaaaa

SEQ ID NO: 8126 - RNA, 89 nt, Zea mays
cuagggaauaugccuggcucccuguaugccacucgcacggcuaccacaccccgguggccgcugcggcuggcgugcgaggugccaggcau

SEQ ID NO: 8127 - RNA, 99 nt, Zea mays
caguccggugcaccagcugaccguuggagcaguccacgugucgcgcgaagauugcgcgaccgaccguuggcucaccggacagucuggugccccaccgga

SEQ ID NO: 8128 - RNA, 255 nt, Zea mays
agaugaugcacuuagucugggugguggcgauggaagaggaacucaacaacuuuacgaggaaugaggucugccauuuaguuccauguccuaaccaaaauguuguagauaccaaguggauauuucacaacaaauaagaugcgcaugguguggugacuaggaacaaagcacgacuuguugccaagggguauucacaaguugaaggcuuggauuucgaugaaaccuaugcacccauagcuaggcuugagucaauucuaa

SEQ ID NO: 8129 - RNA, 280 nt, Zea mays
gggguguuugguuagagggacuaaagauuagucucuagauuuuaguccccauuuagucuuuuuuuugucaaaccacuaggacuaaaauauguacuaaaaugauuuagucuuuaguccuucauauaugugcuagaagggacuaaaccauauuaauuucacauuuaucccucauuuaguucaauuguacuaauagcaggagaauguuaaagaccauuuuagucuucuuaugagucauuuaguauauucuuacuauuuuuagucccuaaaaccaaacauguua

SEQ ID NO: 8130 - RNA, 146 nt, Zea mays
ucgaguggcgcaccagacaguccggugcgccaccggacagcuacuguagccuguccggugcgcgauugccuuccaaaucgggcacaguugaccguugcagcuccgggcccguuggcguaccggacacugucuggugcccccugccg

SEQ ID NO: 8131 - RNA, 91 nt, Zea mays
agcggagaagaagacuucuuguauugucucccagacaguaaggagaucuuugucugccgggagauggcaagaagcuucggauuccggacgc

SEQ ID NO: 8132 - RNA, 151 nt, Zea mays
auccgcgcuccgggccuccggcucuuuggcuuugauagcuuguccucgccccucgaguggggacaugggcgagggccuuauggcagcaucauccgcccugaggucaccgcugcugcuguucggccgcucggagcggaggucguugucgcug

SEQ ID NO: 8133 - RNA, 60 nt, Zea mays
uaucgucuucucuagccacguggcgcccccggagccguccacguggugggguuggguguu

SEQ ID NO: 8134 - RNA, 57 nt, Zea mays
gagagaaaaccccagcucaacugcccggaggcaaguucagcugguguauggucaaag

SEQ ID NO: 8135 - RNA, 147 nt, Zea mays
uauaauucaccggacuauccgguguacaccagacaguguccggugccccagggaagagcgacucuggaacucgacagcuucgggaauucgcuccgcuauaauucaccagacauguccgguguacaccggacuguccggugagccagc

SEQ ID NO: 8136 - RNA, 61 nt, Zea mays
ugacuggaugcuggucggcgacgucccgugggagauguuugucgagucaugcaagcgucug

SEQ ID NO: 8137 - RNA, 83 nt, Zea mays
uaugaccaagucagaccuugugaacaaccuugguaccauugcgcggucaggcacgaaggaauucauggaggcacuuggcugcu

SEQ ID NO: 8138 - RNA, 105 nt, Zea mays
guucuuccuccgaaggagcucuguucuuggcggauuugccgugggguuacuguuccaacagaggacacccacgaaucuguuguauauguuccuuuucuucuccgc

SEQ ID NO: 8139 - RNA, 238 nt, Zea mays
aucugugcuccgggccuccggcucuuuggcuuugauugcuuguccucgccccucgaguggggaugcgggcgagggccuugucgcagcagugucugcccugaggucaucguugcugcuguuuggccgcccggagcggagguuguugucgcugcugcagugguuggcggcgagccacccggauuaaggaacccucggcugcucugcgaugagccggagccggaggcagcggugucagcau

SEQ ID NO: 8140 - RNA, 90 nt, Zea mays
auguacucccucuguuucuuuuuauuugucguuggauagugcaauuuuacacuauccagcgacaaauaaaaagaaacggagggaguauau

SEQ ID NO: 8141 - RNA, 77 nt, Zea mays; identical to SEQ ID NO: 7118

SEQ ID NO: 8142 - RNA, 75 nt, Zea mays
gccggugcgggcuucgcucccccgaugagguccugagcucgcucgucggcggugauguagaggucggcuucccgg

SEQ ID NO: 8143 - RNA, 64 nt, Zea mays; identical to SEQ ID NO: 7555

SEQ ID NO: 8144 - RNA, 71 nt, Zea mays
aucucauggagcagcuguaugacuacaagaugguugagaaccgaucuguaguggaacaggcucaugaguuc

SEQ ID NO: 8145 - RNA, 147 nt, Zea mays
agcgacaacgaccucugcuccgagcggccuaacggcaacagcgaugaccucaaggcggaugcugcugccauaaggcccucgcccacguccccacucgaggggcgaggacaagcagaaggccguagaguuggaggucaguccgcgggc

SEQ ID NO: 8146 - RNA, 109 nt, Zea mays
uucauccggggcaucgaguucccuguaguguaugaccauuauguggcagcuguuuucugcagcgcuucugugagcucaucacucgugcgacucuuugccaaaucaaaug

SEQ ID NO: 8147 - RNA, 76 nt, Zea mays
uguggugacaaggaacaaagcccgacuuguggccaaaggauauucacaagucaaagguuuggauuuugaugaaacu

SEQ ID NO: 8148 - RNA, 78 nt, Zea mays
cuggaccguugccaagugagccugcugcugagugagagucuggaagaucgccgcaagagcagggucaauggcagguag

SEQ ID NO: 8149 - RNA, 82 nt, Zea mays
ugcccuaccugccauugacccugcucuugcggcgaucuuccagacucucacucagcagcaggcucacuuggcaacgguccag

SEQ ID NO: 8150 - RNA, 83 nt, Zea mays; identical to SEQ ID NO: 7285

SEQ ID NO: 8151 - RNA, 83 nt, Zea mays; identical to SEQ ID NO: 7545

SEQ ID NO: 8152 - RNA, 83 nt, Zea mays; identical to SEQ ID NO: 7544

SEQ ID NO: 8153 - RNA, 83 nt, Zea mays; identical to SEQ ID NO: 7285

SEQ ID NO: 8154 - RNA, 140 nt, Zea mays
cgcgcuccaggcagcgaugaaccuggcacgggcauucgaacaccgcaccgaggaucuugacggcgcauagccuauggaagcaagccaccaccccaccccuucggucguccaugccgguucuagugcugccaugcccgugg

SEQ ID NO: 8155 - RNA, 85 nt, Zea mays
uugcauucccucacaaaaagaaggauauaccccaccugcagguccgccagguguggucuauccuccuuuuugugaggguguuugc

SEQ ID NO: 8156 - RNA, 233 nt, Zea mays
gaaacgggccccgagcccuccuacugaucagggguucgaaggcuggccccucggaagggcuggccccucggaaagguucgacagccaccucagagcacucgggcuccacaccacuacugaucagggggucgaaggcuggcccccucgaaggguucgacagccgccucagagcacguagagcgagggaugacuucuggguacgucugauacaugggcgaggcucgggcuaugcu

SEQ ID NO: 8157 - RNA, 67 nt, Zea mays
cggcaaagaaggcuuugccgagugccgcacucgguaaaguuaggcacucggcaaagcgcccuuuacc

SEQ ID NO: 8158 - RNA, 84 nt, Zea mays
caucgccuacgccguccagcaggugugccuccacaugcacgacccucgggagccgcaccucaccucgaugaagcggaucaugcg

SEQ ID NO: 8159 - RNA, 78 nt, Zea mays
gcaccggggaccuccgcggcgccuccggguacgugcuguggaggacggccaagguguggucggaggugcacauggcgc

SEQ ID NO: 8160 - RNA, 66 nt, Zea mays; identical to SEQ ID NO: 7023

SEQ ID NO: 8161 - RNA, 66 nt, Zea mays; identical to SEQ ID NO: 7023

SEQ ID NO: 8162 - RNA, 81 nt, Zea mays
  misc_feature (62)..(62): n is a, c, g, or u
gcgucgacgacggagggagagggggaggaggagucgggcuccgccggcuccccuccuccucnggcuccucccccgacgcug

SEQ ID NO: 8163 - RNA, 80 nt, Zea mays
cuuugggagauggcaggugcuaaggcucugagaaggcuguggccuuaauuuaggggcuugguucacuuguuuuuuuguuc

SEQ ID NO: 8164 - RNA, 65 nt, Zea mays
uugaugacgccggcgaggaucucgaucugcguguccgugaucuugagguccuccuucaugaacag

SEQ ID NO: 8165 - RNA, 181 nt, Zea mays
gcuuccugcuuccucaucagcgcuugcccaguccggccgccguugaguucccuggugcgcccccucagcucacuugccacacucgccucggcucccaguucgacgcacgauuuuggagcucuacgcgaaugacgugcgauuuggugcucugcggcaagcgcuucguguggguggugugguu

SEQ ID NO: 8166 - RNA, 66 nt, Zea mays
ucggggccccggggacgccgccgcuugcccgcaaagggcaccgccgucgcucgcccacuggaucag

SEQ ID NO: 8167 - RNA, 86 nt, Zea mays
uuuucucccagugcacaccacugauaaggcucaaaaguaugcagaguuguacauugaccagaucguguguuugcacggauugcccc

SEQ ID NO: 8168 - RNA, 83 nt, Zea mays
uuuggaauaaucaagugcucugcuccggaguuuggacaacaguacaaacauucucccagcaggcugcuugaugcugcaucuuc

SEQ ID NO: 8169 - RNA, 78 nt, Zea mays
gcgucgacgacggagggagagggggaggaggagucggccuccgccggcuccccccuccuuccccgacgcaggcgccgc

SEQ ID NO: 8170 - RNA, 72 nt, Zea mays; identical to SEQ ID NO: 7907

SEQ ID NO: 8171 - RNA, 75 nt, Zea mays
gcuugaggaagcugcagaaauggugcuugucuucagucuucgacgaguaccaucgcuuugccgcugcgaaagcgc

SEQ ID NO: 8172 - RNA, 243 nt, Zea mays; identical to SEQ ID NO: 1449

SEQ ID NO: 8173 - RNA, 131 nt, Zea mays
accggacaguccggugcacaccggacaguguccggugcccgauuuccuuccaaauauggcgcagucgaccguuggcagccugagagccguuggcgcaccggacauguccggugcacaccggacaguccggu

SEQ ID NO: 8174 - RNA, 77 nt, Zea mays
agggcaagucuuuagcugcagcgcugauguccgaggcaaaguucgacggcgcugacaugucugaaguugucaugucc

SEQ ID NO: 8175 - RNA, 188 nt, Zea mays
aagaccccacuccgccgccacgcgcugcgcgcccuggcgcucgucgcggcgucccacccgcgcgacgucguggccccgcuuaucccgcgcauccucgccgccgcgcuccgccgcguccgggaccaggacuccuccguccgcgccgcgcucguggacaccgcgcgcgccgcggcggcggccucggccuc

SEQ ID NO: 8176 - RNA, 84 nt, Zea mays
uacucccuucguuucguuuuaguugucgcuggauaguguaaaauugaacuauccagcgacaauuaaaauaaaacggaaggagua

SEQ ID NO: 8177 - RNA, 407 nt, Zea mays
ucgaugaggaaggagggcggguacgaggugaucaaggcggccaucgagaagcugaagcugcggcacagggagcacaucgcggccuaccggcgagggcaacgagcgccggcucaccggcaggcacgagaccgccgacaucaacacguucagcuggggcguggccaaccgcggcgcgucggugcgcgugggccgggagacggagcagaacggcaagggcuacuucgaggaccgccgcccggcguccaacauggaccccuacguggucaccuccaugaucgccgagaccaccaucaucuggaagcccugagggcuaaggcggccguuccgucgcguugccguugcguugcaggguccccgaagcgauugcaaagccauuguuccuucuguuccguuugcuuauuauuauc

SEQ ID NO: 8178 - RNA, 93 nt, Zea mays; identical to SEQ ID NO: 7358

SEQ ID NO: 8179 - RNA, 183 nt, Zea mays
aucccggcguccgacggcgaugggcgaggaggacgcgagcgccgggggagauccgcagcggcugaagcggaucgccgcugcggcguacgacuacgagaacgaugcgcggugggccggguacugguccaacguccucgugccgccccaccucgccucccgccccgacgucgucgaccacuucaa

SEQ ID NO: 8180 - RNA, 70 nt, Zea mays
ccugagcagcagucguuugguggagguugucagcauugcaaccacugcucaggcgaagaugaagcugugg

SEQ ID NO: 8181 - RNA, 70 nt, Zea mays; identical to SEQ ID NO: 6857

SEQ ID NO: 8182 - RNA, 71 nt, Zea mays
guccaugguugcaacauucaagcagugugcacgguaucucagcccgcuguuugaguucugcagaaagaagg

SEQ ID NO: 8183 - RNA, 87 nt, Zea mays
acacuacuucgagucucauccggugacuguggugucauccuuccccugggggagaucauccagugccgagaggccucggguaggauu

SEQ ID NO: 8184 - RNA, 81 nt, Zea mays; identical to SEQ ID NO: 7419

SEQ ID NO: 8185 - RNA, 72 nt, Zea mays
ggcucccaugccucaggauaacgagggcuacauuuuguacccugccggcuauccugagagcaaaauuaggaa

SEQ ID NO: 8186 - RNA, 114 nt, Zea mays
gcaagcaagagcgucgggaggucugcucgguaaagguggcagcgccagucuaccuagacugguccgacaagcccaucaccuucgaccagggcgaccaccccgaccacgugccga

SEQ ID NO: 8187 - RNA, 74 nt, Zea mays
uuccgaccguuggcucggccacgugucccgcgcggaucgcgcggccgaccguuggcccuggccgaccguuggcu

SEQ ID NO: 8188 - RNA, 100 nt, Zea mays; identical to SEQ ID NO: 6844

SEQ ID NO: 8189 - RNA, 65 nt, Zea mays; identical to SEQ ID NO: 6787

SEQ ID NO: 8190 - RNA, 57 nt, Zea mays
cccgcuggaccgcgcgucggcgucgccccguggguggcgccaccgcgacgccguagg

SEQ ID NO: 8191 - RNA, 132 nt, Zea mays
cacauggcagccauacaacgcaccugaguaugcugggaugaucuuuaguguaguaugcagcagugaagaugaacucuauaugaugcaauguccuuuggucuguuucugguguguugaguggcaccuaccuca

SEQ ID NO: 8192 - RNA, 125 nt, Zea mays
ggacuguccggugugcaccagacauguccggugcgccaacugcucccagaucagcaacggucgacugcgccauuuaaggaaggaaaucgggcaccggacaguguccggugugcaccggacugucc

SEQ ID NO: 8193 - RNA, 187 nt, Zea mays
acccaacuccuagaagccagcgagcuccauccuugccugcacgaucugucauggcgcagcugcucugaccgcggauccccguggccagccgcggucaucgcuucaaucaccggucaagaguaggaaccauaggaugaggcgcguggaggaugcugugaugaguucgugaguggucuaggucgucguc

SEQ ID NO: 8194 - RNA, 73 nt, Zea mays; identical to SEQ ID NO: 7277

SEQ ID NO: 8195 - RNA, 129 nt, Zea mays
gcaaguggcggcagcaagcuagaggcagcaacugcauaccuugcaagaaaaaaucgguuuuguugacguaccgaagauuuucuugcaaguugugcaguuguugucucaagcuugcugccucccuuugcc

SEQ ID NO: 8196 - RNA, 246 nt, Zea mays
aggcuccacaugaucgauagccggcagcaaaaagacgugacagaacuuuaauaaucccuucgaucuccuucucuuuuccuccucagcacaucgauccuuacgugugcacgcacgcuucugagcucucaaugucugcucucuccuagcuaggcaggcguauguaguuuguuugggucacgcggcucgcaccauguccauggcaccacucauguuguuugcuagcuucugcugucuucuuccuuggcu

SEQ ID NO: 8197 - RNA, 65 nt, Zea mays; identical to SEQ ID NO: 7102

SEQ ID NO: 8198 - RNA, 186 nt, Zea mays
gcggcggcgucggugauggaaggcgucggccgcacgcucaagggccgcgaccuccgccgcgugcgcaacgccgucuggcgcaccaccggcuuccucgaccugugaaaaaggacgucccuuuccuuuggagguuccguuuccuuuccuucucuggccacgucgcuccacuccacuugagcugccugc

SEQ ID NO: 8199 - RNA, 107 nt, Zea mays
caucaggcggcgcugcaguucacguccucgggcucggcgacauuguaguagagcguggacguucugucgucgaacuuggagacgacguggugcggcgucagcccaca

SEQ ID NO: 8200 - RNA, 220 nt, Zea mays; identical to SEQ ID NO: 8038

SEQ ID NO: 8201 - RNA, 160 nt, Zea mays
gcccgauggcucggggacacagugcuugaugguaaagaucaaauagcaaagccccccgaggucugcugccccaugucccugugagcgagcucguaucaucuggggacuguggacccaucgacgguuguacauaucaugcacuugugcucgugccuaugua

SEQ ID NO: 8202 - RNA, 146 nt, Zea mays
cgccuccacgccuccacgccggcacguccucguuucuguccgaggucaucgccuccgcaacuucguggccggugaggucgcaccaccauggcgucgcuccuagcccggcaggcagcgcaggcgcuccgcgcgaggcaaacggcgca

SEQ ID NO: 8203 - RNA, 71 nt, Zea mays; identical to SEQ ID NO: 7431

SEQ ID NO: 8204 - RNA, 70 nt, Zea mays
gcuacuccuaggcggcgccuaggcguuagaccaccguccggacgccuaggcgacgccuuaagaacagagu

SEQ ID NO: 8205 - RNA, 129 nt, Zea mays; identical to SEQ ID NO: 6978

SEQ ID NO: 8206 - RNA, 232 nt, Zea mays
augcgccccgaucaugcuccgccucgcauggcaugaugcuggaacuuaugaccugaagacaaaaacugguggugcaaaugguucgauuagauaugaagaagaguacacucaugguucaaaugcugguuuaaagauugcuaucgaucuccuugagccuaucaaagcaaagaauccaaagauaacauaugcagaccuguaucagcuugcuggagugguugcagucgaagugacu

SEQ ID NO: 8207 - RNA, 175 nt, Zea mays
ugagaccaguggccaugaugugccugcaccagucaacacauuugcagagauugauuugggugaugcauugaagugacaauauccggaggugcaaguaugugaaaccaacaccacugcagcguuacgccaucccacaucuccauugcugggcgggaucucauggccugcgcacaga

SEQ ID NO: 8208 - RNA, 106 nt, Zea mays
aggacgagaagaagcggcgcgauggcggugggcgaccuggcguucaaggcgcugacggcugggcugggcgucgccacgcucuaccucgccgccaccuucuccgagc

SEQ ID NO: 8209 - RNA, 116 nt, Zea mays
gaugccaugguuuuuaaagcgguaaggcgagacaaggcguuggaccaccgccugaacgccuaggcguuggaccuccgccuggacgccuaggcgacgccuuaagaacagugauagau

SEQ ID NO: 8210 - RNA, 214 nt, Zea mays
uggccacucuagccgccucggccgcacugcuaccgcgucgccgacgaggcggagccucaaggcggaggccaagggcgaguggcucccgggccuucccucccccgccuaccucgacggcagccugccgggugacaauggcuucgacccguugggccuggcggaggacccggagaaccugaggugguacgugcaggcggagcuggugaacgggcgg

SEQ ID NO: 8211 - RNA, 213 nt, Zea mays
caucaaggaguacuggcccgaggaccaguggagggaaaugcacccaaacggcgacccggaguuugagcccgagggggacaaaugauugauggcuccccguuuuccucacccggugggugguccccgguccaguuuacauuugcccuuuugaauggaaucgagacucuguuuguucgcauugcucuccagguguucgguuaauguucggaaugg

SEQ ID NO: 8212 - RNA, 63 nt, Zea mays
agcugagaacgggcgggugcaagugcggcggcaacugcaagugcgaccccugcaacugcggca

SEQ ID NO: 8213 - RNA, 77 nt, Zea mays; identical to SEQ ID NO: 7118

SEQ ID NO: 8214 - RNA, 133 nt, Zea mays
ucucucugcauguuuggcgucagucuuugugcucauguacgugugucuacaugcauguuggcccgauacgacugcgacugcuguauccauauaccauuugggccacgaugauaugacuuuggacuauaucugu

SEQ ID NO: 8215 - RNA, 75 nt, Zea mays
cacaagcacacacuagcacaaggaucguucgaucguucuucgaucguuuguccccuguucuuaguuuguucguuc

SEQ ID NO: 8216 - RNA, 116 nt, Zea mays
auuggguuagggggauuguugucuggcucggugucuccggucgagacggccuugccggcgccggagcugucgucgaccggagaucucggaccaggcuucaaucccuuuaaccaugc

SEQ ID NO: 8217 - RNA, 100 nt, Zea mays
ccggccugagccgccccgcauccccaucccgccgacgugcgcgucccuucgggugggcgcgccgucgucggaugggugcugcgcgguggucgaggcccag

SEQ ID NO: 8218 - RNA, 60 nt, Zea mays
cccgcuggaccgcgcgucggcgucgccccguggguggcgccaccgcgacgccguaggagg

SEQ ID NO: 8219 - RNA, 268 nt, Zea mays
gcagcaaguucggcuacugcggcggcggcggcggaggcggaggcaguggcggugcgaacguggcuaacguggucaccgacgcguucuucaacggcaucaagaaccaggccgggagcgggugcgagggcaagaacuucuacacccggagcgcgucccugagcgccgucaacgcguacccgggcuucgcccauggcgggacggagguggagggcaagcgcgagaucgcugccuucuucgcgcacgucacgcacgagaccggacauuucug

SEQ ID NO: 8220 - RNA, 101 nt, Zea mays
acuaugacgugcuauguguacaaaccuaagagauccacauugaaacucuaugauuucauguguaguucucuuagguuucuacacauagugucucauaacuu

SEQ ID NO: 8221 - RNA, 71 nt, Zea mays; identical to SEQ ID NO: 8182

SEQ ID NO: 8222 - RNA, 241 nt, Zea mays
gcacgacuaauaugcaagcagguaauaugugcaagcacacaagcagacauuuugauccguuagaucuagauccaacgcuaugucauauuuagcacuuaaacucuuccaccaccaccugauauagcuuuauaaaaaaacuccuaacaaaccacaauuguauuuaccguuggauacagaucuaacaggcuaaaaagucugcuuauacgcuugcaccuaguaccugcuugcauauuaguuguug

SEQ ID NO: 8223 - RNA, 61 nt, Zea mays
gcugcauaacaacgaagagaaggccuguugccacaauaaggaccaggaaucucuucgcuga

SEQ ID NO: 8224 - RNA, 67 nt, Zea mays
ugguucuuagagccagugguucguggugacuaacccuucuccaugagaucauuggcuagggaacgac

SEQ ID NO: 8225 - RNA, 94 nt, Zea mays
caccacaaggucgaggaugucuugcaacugcggaucaagcugcgguugcggcucaagcugcaagugcggcaagaaguacccugaccuguaggag

SEQ ID NO: 8226 - RNA, 102 nt, Zea mays
aaaaucauugguccacccaaggcauaucaccucacuauggaagaacgaaagucugcuuuacucuacauguucaugaauaugccuaagguggagaaauacuuc

SEQ ID NO: 8227 - RNA, 85 nt, Zea mays
ggacgggcaucuuaccauaacaauauaagacgcauuguguauauauaacacaugugcauauauaaguuaucgagauauuauaugu

SEQ ID NO: 8228 - RNA, 77 nt, Zea mays; identical to SEQ ID NO: 7118

SEQ ID NO: 8229 - RNA, 208 nt, Zea mays
gcucaucaucggcggcaagguguaugaugugacgaaguuuuugguagaccacccaggaggugaugauguucuguuguccucaacugguaugccuucuugucuuugcguaccacuaaaccagugccuggcuaagguugcgaaaggcaaggaugcgacugaugauuucgaggaugucggucacagcaacacugcccgcgcgaugauggau

SEQ ID NO: 8230 - RNA, 142 nt, Zea mays
augccgccagaauuucucgucguguucguccucggccgcggauucgccucccuccguggaccagccccaccacaacgccuucgccggagaagaacaggugguucaagaggagccacacaacgaggaguucgauucgaucuag

SEQ ID NO: 8231 - RNA, 82 nt, Zea mays
gaccaacaacugcccguacaccgugugggcggccgccgugccgggcggcgggcagcagcuggacaacgggcagacguggagc

SEQ ID NO: 8232 - RNA, 238 nt, Zea mays
agcgaugcgcugcccuuggugucgauccgggcugcuggucacgccucgaagcucucuccccauccgcgcuaugguguacaggccgaccgcuggucugcgucucaacaugcugaugugcccagaccgucagugucgccuuuaccgucaaaaggacguccgcggauaggugagcagguacguuaaauaaucgcgcgaugcggaagaacagccaagucgaccccaagcgcgggcaaauccg

SEQ ID NO: 8233 - RNA, 73 nt, Zea mays
ugaaccacgugcuugcacaacucaacuccgaucccguucaggaccgagagaugaugaucgagcaacugaugug

SEQ ID NO: 8234 - RNA, 273 nt, Zea mays
gcgaagaagcgaucggaggcgccaucaauuucucgccguuagucugacgccgccgcuaauccgcuccccaccguugauagccccagcguugcuacaaucggagcgcgaggacacguaucaucugaaaagcaaguugguaccuggauucucaagugccaggagaagagcagguggucgaagaggagccgccuaacacugaggaguucgaucugaucuagguggcgugucucggucgacauuggcgccgacgauccuuaguucguuuuacauuua

SEQ ID NO: 8235 - RNA, 71 nt, Zea mays; identical to SEQ ID NO: 6870

SEQ ID NO: 8236 - RNA, 129 nt, Zea mays
gcaaguggcggcggcaagcuagaggcagcaacugcauaccuugcaagaaaaaaucgguuuuguugacguaccgaugauuuucuugcaaguugugcaguuguugucucaagcuugcugccucccuuugcc

SEQ ID NO: 8237 - RNA, 127 nt, Zea mays
ccaccggcucgccucgcggcucgcgcacggcaaaccacucuaugacucacaugcgacugguagcaugcugcaucacgucugccggaucgggcgcgccgaacccgagccgcgcggcgguggccggcuu

SEQ ID NO: 8238 - RNA, 251 nt, Zea mays
augcgugggagcggagucuggaugccuuaguaugcuuagagaaugcuuggucuucuccuccaugcgccuagggggucucuuuuauagcccuaagguagcuaggagccguuggagaccaacuuggaaggcaauuccuuccuucugucgaguggugcaccggacaguccggugcaccaccgaacaacuacuguucagguccagugcgcaaucuccuuccauaucgggcgcauccgaccguugcuccucggggc

SEQ ID NO: 8239 - RNA, 108 nt, Zea mays
gcucucaauccauguggauuggguggaauuggauggguuucaaucccaaacaagucaaaaucuuucauaauuuuuuccaaucccauccaauccacaugggauaggaau

SEQ ID NO: 8240 - RNA, 232 nt, Zea mays
ccaggauggcggaggccaucguugguccgcugguggggaagcuccaggagauggcggugagcgaggcgaaggcucuaguggcagugaacgacgacauccgcggccuccgggaccggcucauguggaugcaggccuucuugcggcaugccgacccgcggcgacgcgacaccuccgacgagcucaucagggcguggcucaagcagacccgcgauguugccuucgacgccgagga

SEQ ID NO: 8241 - RNA, 75 nt, Zea mays; identical to SEQ ID NO: 8171

SEQ ID NO: 8242 - RNA, 113 nt, Zea mays
uuugguuuggggcuaaaugugccacacuuugucuaauguuagucguccaaauugaauaauuaaucuuaaacaaaaaaguuaggcaaaguguggcaauugagguaacgaaccaa

SEQ ID NO: 8243 - RNA, 269 nt, Zea mays
gguguguuugguugaauggacaaagagggacggaacgaggcggccacaguuucagucauguuuggaugagggucaagcaggggcgaguugaaccccagaccauuuuucgguggcggcgccguccccaaaaaaacgagcggaugaggucgcccccaccccugucgcggugcuggaaaaaucguguugccucccaacaagugacaaaacuaccauccaaacaaaaacuguguugguuccauccaaguuuaucccuucaaccaaacaaaaac

SEQ ID NO: 8244 - RNA, 71 nt, Zea mays; identical to SEQ ID NO: 7867

SEQ ID NO: 8245 - RNA, 100 nt, Zea mays
aguuguccucgggccugaaggcgaggugccuguacaugacgccggugccgcggagcacucggcgguggcgggcgcgucggcggcgggcucgacgacgacc

SEQ ID NO: 8246 - RNA, 99 nt, Zea mays
ggccugaccgucgacgucgacgccaacgggagaaagggcaagggcaagggcguguaccaguucgucgacaaguacggcgcgaacgucgacggauacagc

SEQ ID NO: 8247 - RNA, 71 nt, Zea mays
ccuggcgaggccugacugccugucagacucacucuaucgaguggcacugcagucggaguggcgcaggcggc

SEQ ID NO: 8248 - RNA, 58 nt, Zea mays; identical to SEQ ID NO: 7529

SEQ ID NO: 8249 - RNA, 80 nt, Zea mays
agcuaacccuuugguuggcuuuuggcuuuuagggggccaaagccaaaagccaaaagucaaaccaaacacacccugagucg

SEQ ID NO: 8250 - RNA, 69 nt, Zea mays
gcagcuccaggggucuugaaguggucaucacauucuugcugugaugcuacuccuaccaccuguuuccug

SEQ ID NO: 8251 - RNA, 85 nt, Zea mays
gacaugcugggcaggugaugaugauguuuggacugauacuugaugucucaaaaucgagcuuuuuaaaacugaugcccaguucauc

SEQ ID NO: 8252 - RNA, 65 nt, Zea mays; identical to SEQ ID NO: 7739

SEQ ID NO: 8253 - RNA, 80 nt, Zea mays
ccaugguauacagcggcgaccaugaccugcuggugccacaucugggcacccaggccugggucaggucgcucaacuucccc

SEQ ID NO: 8254 - RNA, 67 nt, Zea mays; identical to SEQ ID NO: 6904

SEQ ID NO: 8255 - RNA, 95 nt, Zea mays
cggggcucucugcggaggcgcggacgguccgcgacacaggaccggacgguccacgaccugucgcgggaacgacuccuccucugcacacuucagga

SEQ ID NO: 8256 - RNA, 87 nt, Zea mays; identical to SEQ ID NO: 7301

SEQ ID NO: 8257 - RNA, 267 nt, Zea mays
gagauuucagaagaccugucagaaugcggccuuaucauaggcaucaaacaacccaagcugcagaugauucuuucagauagagcguacgcuuucuuuucacacacacacaaagcccaaaaagagaauaugccacuguuagacaagauccuugaagaaaggguguccuuguuugauuaugagcuaauuguuggagaugaugggaaaagaucacuagcauuugggaaauuugcugguagagcuggacugauagauuucuuacauggucuc

SEQ ID NO: 8258 - RNA, 61 nt, Zea mays
cgcucgucuaccgcuacagggacgcgccgucggaggcggcguuccuugcggacuucggagc

SEQ ID NO: 8259 - RNA, 288 nt, Zea mays
cauguaagaaaccacuaauacaagggccaagugcacagaagaaccuacuaaaauaaacucugccauccucaacaaguacaucaauuucaaugacacugucaggugaccucugcaauacagccuccuuccaagagaauagaaguuggaaacucucuucccaagucccaaacaacuccuucaaggcuuucucuuuuccauaccaaacuguaucauaagaaauggugcacuuguacguaucuugaaggaaagucuguaaauccuuugcaccugugugugguuucuucgcaa

SEQ ID NO: 8260 - RNA, 197 nt, Zea mays; identical to SEQ ID NO: 7630

SEQ ID NO: 8261 - RNA, 219 nt, Zea mays
uucuaauuaaucauaaugaucugcauagguuaauuuugaugggacccaauaggauacccuaguuugucuaucuuuauaccuuguuuaccacugaacuuucuggguaguacuugcuagugcuauaugugguuuuggguauggagauacauuauucaugauuacacuuuuguuaucaguuguuauuuauuguucauguuaagaccauuauguuaauuggaa

SEQ ID NO: 8262 - RNA, 87 nt, Zea mays
uucugaaacuccgcggcaagcugcuguugcugaacucuaccucuuggauuucgggaugaugguagcaaggcgcaaggauguuguacu

SEQ ID NO: 8263 - RNA, 171 nt, Zea mays
ggaccugguagauuugguucagaggcgauuuuuguucccaagcauccaggugugucuggagaagaagaugacggcuauuugauauucuuuguacacgacgagaacacagggaaaucugaaguaaauguuaucgaugcaaagacaaugucugcugauccaguugcggugguu

SEQ ID NO: 8264 - RNA, 65 nt, Zea mays
guguuauuacgaaaacgguacgguaaacggugagacauauuuaccguccguuuucggaauucucg

SEQ ID NO: 8265 - RNA, 238 nt, Zea mays; identical to SEQ ID NO: 6961

SEQ ID NO: 8266 - RNA, 90 nt, Zea mays; identical to SEQ ID NO: 7642

SEQ ID NO: 8267 - RNA, 72 nt, Zea mays
uuuuuuuuuuuuaaaaaacuuuuaucacuuaaaugcugcauuaggugauaggaguugugugaauaaacaauu

SEQ ID NO: 8268 - RNA, 106 nt, Zea mays
uuuugcaaaacuccgauggugacguaauaauuuaauacucuuacaugcaugguuuuaugcuuuauuguauuugcucugugacucaccaucgagugagauuguggua

SEQ ID NO: 8269 - RNA, 138 nt, Zea mays
ggggauucggacgaggcggccagugcucucuccucauagccagcuucuccuguucaagcucaguucuuguucauccagcagagcacaaaaaaaaacagacaggcggagugauguacuuacuauuccuccuccuccucc

SEQ ID NO: 8270 - RNA, 168 nt, Zea mays
ucaaaaaaauguaacgcaaaugguaaugguaacgguuuacgaucuauuacuagugguaacaaauuuaaauaggcugguaucaauuuuuagugugguaugugauuacgguuagacuaaaacaaacaugauuuaacguuaucaguuacccauuacguuacaaauauauga

SEQ ID NO: 8271 - RNA, 82 nt, Zea mays; identical to SEQ ID NO: 7272

SEQ ID NO: 8272 - RNA, 71 nt, Zea mays; identical to SEQ ID NO: 7009

SEQ ID NO: 8273 - RNA, 82 nt, Zea mays
cucuggcucgugagcuaaacgagccaguucgagcucguaaacgagccgagccgagcuggcucguuagcuuaacgagccagcu

SEQ ID NO: 8274 - RNA, 73 nt, Zea mays
uaacauguuugguucuagggauuaaaauuaguaagaauauacuaaaugacucauaagaagacuagugcaauug

SEQ ID NO: 8275 - RNA, 81 nt, Zea mays
gggcuuggacugggccucggcgucggcgcagguaccggaggagugucggugucugggccgaagccgaggccgccggcgcca

SEQ ID NO: 8276 - RNA, 109 nt, Zea mays
agcuuccaauccacauggauugagugggauuggguggguuuaaaucccaacuaagucaaacucuuucuuaauuuuuuccaaucucauccaauucauggguaacgggauu

SEQ ID NO: 8277 - RNA, 67 nt, Zea mays; identical to SEQ ID NO: 7019

SEQ ID NO: 8278 - RNA, 146 nt, Zea mays
cuuuaccugagcgcauguuugguugccugcacgucgaaggcguggaacugcacgagccgaugcaaaaaaaccauuugaaagcuaauugucugcauccgcucguaccgccaaaacgcccguauccgaccagucaggcucgggcaagc

SEQ ID NO: 8279 - RNA, 273 nt, Zea mays
cccuccccaucggcuucgccguguucauggugcaccuggccaccauccccgucaccggcaccggcaucaacccggccaggagccugggcgccgccgucaucuacaacaaggacaagcccugggacgaccacuggaucuucugggugggcccccucgugggcgcugccaucgcggccuucuaccaccaguacauccuccgggcuggcgccaucaaggccccucggcuccuucaggagcaacgcgugaugagcggggcuuggcuguggagcaaug

SEQ ID NO: 8280 - RNA, 77 nt, Zea mays
caccaaaauagugaacuuccuagagccuaaacccuagaaaguuggcccuaaacucuaggaaguuagcuaaacccucg

SEQ ID NO: 8281 - RNA, 66 nt, Zea mays
agaagugcauggaaagaagcuauccacgugcccaaacagugauuaggcuuuuuucuuuuagugcuc

SEQ ID NO: 8282 - RNA, 322 nt, Zea mays
uccucugaaauggcggcggcgacuuccucuuccaccuaccucgccaucggccgcaaaacccuaaaccccgcccccuccguagccacagccgccaccuccgucuccuuccccgccacgcagcacccaugccucgucgccgccuccgcggaccgccgccgcgccguggcugcgaaggucucgucgccgucggucaucggcaccgccaugccgucacucgacuucgagaccuccgucuucaagaaggaaagagugucccuggccggccaugaggaguauauugugaggggugggagggaucuguucccgcuguuaccggaggccu

SEQ ID NO: 8283 - RNA, 113 nt, Zea mays
guucucuacuccucacagagggugaugcuggagacuuugauggagauuuuaucgacgacgaugauuucuaagucuaacgaugcgccggucaucuuccugugggagauugcuca

SEQ ID NO: 8284 - RNA, 242 nt, Zea mays
gugcgcgagguggagaagcagggcacgugcauucauucguuccaucgacggucuggcgccgacucacgcaucgccggcgcggcgagcugagcgcgcgacacggaagcagguccgccgcgccggcggcgcccgcuggccgaucgaccggcuaacuauagcuagcuccaggaagcaagccaggccagccagccagccgaucgaugcuugcgcgugcaugugcccuucuucuccaucgggcacgc

SEQ ID NO: 8285 - RNA, 99 nt, Zea mays
gcucucaauucauauggauugagugagauuggguggguuuaaaucccaagcaagucaaauuucuucacaauuuuuuccaaucccguccaauccauaggu

SEQ ID NO: 8286 - RNA, 71 nt, Zea mays
cccuuguuguuauaaaacuuuuaucacuuauauguugcauuaggugauaggaguugugugaaaugcauuac

SEQ ID NO: 8287 - RNA, 85 nt, Zea mays
acggcgccuaggcucaggcuccgcgacggccgccaccucgccuacugcgagagcggcgugccccgggaccaggccaaguucgccg

SEQ ID NO: 8288 - RNA, 247 nt, Zea mays
gcagcagcagccucagcaggcggcagcggcagccaccggcguguggaagacggucaagcccuucguuaacggcggggccucugggaugcucgcgaccugcgucauccagccuaucgacauggucaaggugaggauccaguugggugagggcucugcuggucaggucacaaggaacaugcuugcaaaugaggguguccguucuuucuacaaugguuugucugccggauugcugaggcaagcgacguac

SEQ ID NO: 8289 - RNA, 200 nt, Zea mays
caucggcuggcgcgucagccacaggggcaucggcggacuuugccucggccaucggugcuacgaccauggcgacgaagaggagagcggcaaugacaaagacgacgcuagcgcgagccauggguacggugucuagcuuucuaggguugguugauagcugcuuaggcgaguucaacgcuuggugucucugugccggacgcgug

SEQ ID NO: 8290 - RNA, 62 nt, Zea mays; identical to SEQ ID NO: 7617

SEQ ID NO: 8291 - RNA, 267 nt, Zea mays; identical to SEQ ID NO: 8257

SEQ ID NO: 8292 - RNA, 240 nt, Zea mays
ccccucucgcccccgcccgcucgcccgcuccucgaucccgcccgcucugcagccgaucccgccgggagcacgaccgauuacgaugaacggcgccgcggcaccggagcgcucgcccucacccucgcccccgccuccggcccaggcccaggcccaggcgccgccgucgcccucuccggcucagccgcucgaguggagguucucccagguguucggugagcgcagcgccggggaggaagucca

SEQ ID NO: 8293 - RNA, 89 nt, Zea mays; identical to SEQ ID NO: 7380

SEQ ID NO: 8294 - RNA, 63 nt, Zea mays; identical to SEQ ID NO: 6697

SEQ ID NO: 8295 - RNA, 235 nt, Zea mays
ucccauuaacauaaugaucuuaucaugaauaauaauaauaaacagauaauaacaaguguaaucaugaguagugaauaucucuauacccaaaaccauauaaagcaauagcauguacuacccaaaaguuuaguaguaaaaccaguggugaaacaagguauaaagauagucaaaaucuaggguauccuauugggucccaucaaaauuaaccuaugcagaucauuaugaauaauaagaa

SEQ ID NO: 8296 - RNA, 114 nt, Zea mays; identical to SEQ ID NO: 7463

SEQ ID NO: 8297 - RNA, 72 nt, Zea mays
aguaggauugugcauaaguuggauguacgagaugacucauuccucguacucagcauaugcuauaagcuauau

SEQ ID NO: 8298 - RNA, 107 nt, Zea mays
ggggagaaucuggcuguguagagaaucugaguaucauuaggauuacgugcggaggaagauaaaguuguccauggggcucaggaucuauaaagugacggauuacuacu

SEQ ID NO: 8299 - RNA, 446 nt, Zea mays
gaagcaaaacagagacacaagcugcagcggcacacauggggcaccgcgccccacuaccaccaccagaccagacgacgcacacuuuauuuagcccaugucacucgcaguccgcaccgggcacugcuauagcuacgacacacacacugucacacacggagagauggagagaaaccgucgcguucgcguugaacugaacagcaagcccgugccauguaggcgcgcgcgcgacaaggcugccaggccacgcgcugagccaucgaucucacgacccgauguccgccggcgcagugcgcacacggugcacggucuuacucgcuggccuuaucggucaccucagcggccggcucggccuuaucgggcuccucagcgaccggcucagccgccguggucuccucggcagcagcagccuggggcuacgcggcugccggcucuguuucugucucagc

SEQ ID NO: 8300 - RNA, 84 nt, Zea mays
gcgaggcagaaagcuugaggcagcaacugcauaacuuaaaagagcaccaucggcaguuguugggucagcagcuuucuggccuga

SEQ ID NO: 8301 - RNA, 83 nt, Zea mays; identical to SEQ ID NO: 7308

SEQ ID NO: 8302 - RNA, 159 nt, Zea mays
uguauucuuggccgguguaguuguagugcagugccacucacguucgguggcgggugguacgugcggugcggacguaccaccgucgccucggauucuuucuuucucuucucucuuccuuuuuuuuuguuuugcuguacuauauugcgacccccauugaga

SEQ ID NO: 8303 - RNA, 137 nt, Zea mays
ucuguccagauagccaaggaugacuugccuguggcuucuuggcuuggcuuggcucgggcugauuaaaaccuugugcacguuuuauugcucgccucguggccucgaucacaggcagucuccuuggcuaguccgggcgg

SEQ ID NO: 8304 - RNA, 233 nt, Zea mays; identical to SEQ ID NO: 6758

SEQ ID NO: 8305 - RNA, 379 nt, Zea mays
caaaccauaaugccugacccugcuuauucgaucuuucuuaaggacaacuauguuugggcuacucuuguuuguccgcuucuuauucuucuucuucucgauguugcacuguugcugcuuaauuacagcugagagcuccuguguugauuuaaauuggccuccuauaucguucccuguccugacugcucgauguaccugccagcgguguggaaauuaaaaggcaguugaggagccuaguuuguuuuucuuaauugaugucuuuuggagaacauuuguugucaguugccuaauuaaaauuguugguggauuucaaaguguguagugcuguguaaguugugccuuccuggguaagaguugauggguggaucgggcgccggagucu

SEQ ID NO: 8306 - RNA, 114 nt, Zea mays
gacccucucugccuggccgacgaccccgaggccuucgccgagcucaaggcgaaggagcuuaagaacugccgccuggccauguuuuccauguucggcuucuucguccaggccauc

SEQ ID NO: 8307 - RNA, 128 nt, Zea mays
gaaggcccuccgggggcgaccugagaacacaugcaagaucaacgcgcgccgacggcccaggccagcacgaccgagcaaugaucucaucucauucccauguguucccaguccgcccccgccggaacugc

SEQ ID NO: 8308 - RNA, 71 nt, Zea mays
cgagucagccuggcgcaccggacacuguccggugcaccaccggacaguccggugugccagacugagcugag

SEQ ID NO: 8309 - RNA, 65 nt, Zea mays; identical to SEQ ID NO: 7261

SEQ ID NO: 8310 - RNA, 81 nt, Zea mays
ucucuggggguagugacgaggaaugcugugugcagguagguuuucguguauccuggauuguuugucgacugacugcgcaug

SEQ ID NO: 8311 - RNA, 76 nt, Zea mays; identical to SEQ ID NO: 6920

SEQ ID NO: 8312 - RNA, 73 nt, Zea mays; identical to SEQ ID NO: 7381

SEQ ID NO: 8313 - RNA, 84 nt, Zea mays; identical to SEQ ID NO: 6851

SEQ ID NO: 8314 - RNA, 77 nt, Zea mays
gccacuccagcaggggggcggccuguccgaguucuccgggcucaggagcuccgccguccuucccaugcgccggaaug

SEQ ID NO: 8315 - RNA, 270 nt, Zea mays; identical to SEQ ID NO: 6944

SEQ ID NO: 8316 - RNA, 105 nt, Zea mays
agggcaguaggggaguggucaguguagggaggcccuuugggaugauuuugcugcgauggcggucaugcgagggauuccugcauuggagcuuccuauaaacuguag

SEQ ID NO: 8317 - RNA, 91 nt, Zea mays
uuaggcuccgcgguggcaucauugagcccucgcugcaggcgcucgcucgcaaguacaaccaggacaagaugaucugccgcaaaugcuaugc

SEQ ID NO: 8318 - RNA, 73 nt, Zea mays
gagucugcacccacaucaaugucugagccuuacacaccaacggcucagagcuuugguggugggaacccugugg

SEQ ID NO: 8319 - RNA, 335 nt, Zea mays
ucucggaggcgaucugcugccagccgucgucgaugaugaggaaccgcggcggcgcgccgcccuuggacaggcugcaaaagcagaggagaguugccgcgucaggacggcacguuggcacggaggagucacugacacgcaagagcggacagagcgcgcguaccucugaaggccguguuugacgccgucggcggugacgucgguguagaaggcgucccaggugcaccagccgaaccagucgaggaacgacggcagcuucuucuugucgcggugguggaacgucugcaggugcuucucccccgucuugacggcggcggugacggugucgaagggguugu

SEQ ID NO: 8320 - RNA, 100 nt, Zea mays
aacggaucacaugcgcguguucuugguguugguacagucauucugaaguuuacuucaggaaagacggugcuauugaagaacgugcagcaugugccccucc

SEQ ID NO: 8321 - RNA, 90 nt, Zea mays; identical to SEQ ID NO: 6835

SEQ ID NO: 8322 - RNA, 117 nt, Zea mays
gccuuccuccaccgcgcgcuuguccucucgucgcugcuccuucucgccuccggcgaaaucuucuucgaggaacgguucgaugaugggugggauagccgcugggugaaaucugauugg

SEQ ID NO: 8323 - RNA, 217 nt, Zea mays
cggcaaggagcuggacggccgcaacaucaccgucaacgaggcccagucccgcggcggccguggaggcggcggcggcugcuacggugguggccguggaggcggcggcuacggcgguggcgggcgccuugauggcggcggcggcuacugcgguggcggcggcggcuacgguggcggcgguggcuacggugguggugguggcggcucuggcgguggcauc

SEQ ID NO: 8324 - RNA, 207 nt, Zea mays
guuguugggggggcgacgaugacccccagcauaauccaaaaccguccaagaccucuccccuuccggccgaaucaacggccgucugucccgaaguaugggacgcggcgggagacucgcggggccucgcagguagaugcuccucgaacuagagccgccugaaccugaggcguccugcugcuggucgucgucguccugcuggucgucguc

SEQ ID NO: 8325 - RNA, 58 nt, Zea mays
ucauuuuauuuugucaagcaaaugugcugcuuugcgcauuguuugacauuauauuguu

SEQ ID NO: 8326 - RNA, 114 nt, Zea mays
ggccgcccaccgucuccauggucguccgcgccuccgccuacgccgaugagcucgugaagaccgcgaaaacgaucgcgucgccggggcggggcauccuggcgauggacgagucga

SEQ ID NO: 8327 - RNA, 93 nt, Zea mays
acggacgagugcccuaguggccgaggugucgcgcuccacaagaucgugacagucauaggaggugguguaucgguugcuaaggcacagcgucuu

SEQ ID NO: 8328 - RNA, 178 nt, Zea mays
augcggcggcggcggcagggccauggcggugcaggccgggugccggggggcugcaggugucacgacguccgcgccgcguccgcgcauggcguccacaugggcguccgcgcgccccgcggucuuguucgcuucucccccaugcugcugccuugccuugccuugcuugcucccguugccc

SEQ ID NO: 8329 - RNA, 73 nt, Zea mays; identical to SEQ ID NO: 7024

SEQ ID NO: 8330 - RNA, 79 nt, Zea mays
guuucgugggugagcggaucgagauggcggcgucggauguugaguaccgcugcuucgucgggcggcucgccugggccac

SEQ ID NO: 8331 - RNA, 81 nt, Zea mays; identical to SEQ ID NO: 6702

SEQ ID NO: 8332 - RNA, 128 nt, Zea mays
cggccggguggcggaaugcagccgcccuaaauucuaagaugagaaagggaccuaagcguuuugcccguuagauggauucgggaugaacacgcaagaguuuagagugguucgggccgccggacguaaua

SEQ ID NO: 8333 - RNA, 59 nt, Zea mays
uucuugccauccgggcugcugacgucgaccucggcgugcggcgccggcgguggcgcgug

SEQ ID NO: 8334 - RNA, 106 nt, Zea mays
ccgucuccaggccuggacugggggcaacuguacauggugccuggugguguaauguaacauaacggcaauggcauaugcagcugauccuggucugccuguaucaucu

SEQ ID NO: 8335 - RNA, 78 nt, Zea mays
uagcaauuaagcaugugucgaguucagcucuaucaaaaucuaguaaguauagcugacccucuaacacacccuuaaaug

SEQ ID NO: 8336 - RNA, 78 nt, Zea mays
aaugucagaacgacacugcucuucggauggcccaguuuuuagaggagcauccaaagauugcucgugucuacuauccug

SEQ ID NO: 8337 - RNA, 75 nt, Zea mays
cacaagcacacacuagcacaaggaucguucgaucguucuucgaucguucguccccuguucuuaguuuguucauuc

SEQ ID NO: 8338 - RNA, 84 nt, Zea mays; identical to SEQ ID NO: 6851

SEQ ID NO: 8339 - RNA, 60 nt, Zea mays
uuguuuuaaaacuuuuaucacuuauaugcugcauuaggugauaggaguugagugaugaaa

SEQ ID NO: 8340 - RNA, 194 nt, Zea mays
accgucaccguucaagaaagccuguggaaaaucaaccuaagaagaccaccaaggaggugccugcugcugcuggcucauugccaugugcugggccacaagguagcuugaagaaggcaaaaguuaaugacuccaagccaggcacugucagcuauugggcagauaguuuaaacaggacaauguugagcagagagaaa

SEQ ID NO: 8341 - RNA, 78 nt, Zea mays
ucugcugaagacgucgucgaugccgagggagagcuuccgaacgugaagacuuguucgguccacggagucgcuuuaucc

SEQ ID NO: 8342 - RNA, 64 nt, Zea mays
aacaaccuggcgggcguguggcucggcgagcucucgucggcgcugcaugggacguggcaggcgg

SEQ ID NO: 8343 - RNA, 68 nt, Zea mays; identical to SEQ ID NO: 6867

SEQ ID NO: 8344 - RNA, 109 nt, Zea mays; identical to SEQ ID NO: 8276

SEQ ID NO: 8345 - RNA, 137 nt, Zea mays
ucccuguuugacaccuuccgcacucauuauuaccacaugcauccuccgccgagugaucaguaaggccucuccuuuguggcaauugaugccaaagggggagagaagugaugagaaguugucaggcgucuccuucaggg

SEQ ID NO: 8346 - RNA, 73 nt, Zea mays; identical to SEQ ID NO: 8318

SEQ ID NO: 8347 - RNA, 75 nt, Zea mays; identical to SEQ ID NO: 8027

SEQ ID NO: 8348 - RNA, 137 nt, Zea mays
uuuuguuugauuccggcucucaucaagugacuccucccccucacgcugacuaaaagaaacagaugucucaauucuagugguggagcuacgaacaacaaucugauguccugaucgagagcgauggagcuaauguuuga

SEQ ID NO: 8349 - RNA, 61 nt, Zea mays
uugagaucacggccgacaucuuugguaucaaggaugacaagggugaaggcuaccuggucga

SEQ ID NO: 8350 - RNA, 60 nt, Zea mays
uugagaucacggccgacaucuuugguaucaaggaugacaagggugaaggcuaccuggucg

SEQ ID NO: 8351 - RNA, 232 nt, Zea mays; identical to SEQ ID NO: 8206

SEQ ID NO: 8352 - RNA, 60 nt, Zea mays
uuuacuuagaccugggcgcuuugacagacaggugucuguugauguuccagauguacgugg

SEQ ID NO: 8353 - RNA, 91 nt, Zea mays; identical to SEQ ID NO: 8317

SEQ ID NO: 8354 - RNA, 71 nt, Zea mays; identical to SEQ ID NO: 7009

SEQ ID NO: 8355 - RNA, 105 nt, Zea mays; identical to SEQ ID NO: 7288

SEQ ID NO: 8356 - RNA, 433 nt, Zea mays
gugauccacuggcggugagcgaugcugagggcgcugggcugcgucaccccggaggugcuccagagcugggugcgcguggacuucagggagcccgugugguaaguucaaggcccgcgcgcagaucuucuccgagggcgggcuggauuaccugggcaaccccaacccggugcacgcgcagagcauccucgccgugcucggcucccaggucguccucaugggccucgucgagggcuuccgcgucaacggccacgacggcgucggcgacggcgacggccucuaccccggcggccaguacuucgaccccucggccucgccgacgaccccgucaccuucgccgagcucaaggucaaggagaucaagaacggccgccucgucauguucucuauguucggcuucuucguccaggccaucgucaccggcaagggaccccucg

SEQ ID NO: 8357 - RNA, 73 nt, Zea mays
cucgagcgcuccugcaccgccgaguucuccggcuuccuccucuacaaggagcucggccgcaggcucaagaaaa

SEQ ID NO: 8358 - RNA, 160 nt, Zea mays
ggccugcgcccgcggcgccgccgauccaagaugccuucgugcgugcagggcugcugcugcugcucgucccugcgccuucucccccgcgacgacgcgcucucgucccccuccgccugcgcgcaccgccugaagccuuggucuuggcgugcccaauccccca

SEQ ID NO: 8359 - RNA, 73 nt, Zea mays; identical to SEQ ID NO: 7931

SEQ ID NO: 8360 - RNA, 91 nt, Zea mays
ucacgggcaaggggcaggacaugguguucacgguguacggcgaccacuggcgcaagaugcggcgcaucaugaccguccccuucuucaccaa

SEQ ID NO: 8361 - RNA, 153 nt, Zea mays
cgcagaaucgaaaguuagugcagccuccagaagggacauucuucuaacgaaguguucacuuggcccgucaugggauccaacaguaauugaaaguuuuaugggcuaaaaaacagcgucuacaucuggugccccugccugucuuugugauuuuuu

SEQ ID NO: 8362 - RNA, 69 nt, Zea mays
cgcacgccgaggucgacgucagcagcccggauggcaagaagggcuugcugggcaagaucauggacaaga

SEQ ID NO: 8363 - RNA, 67 nt, Zea mays
cuuccagaacacgcagggucucaucuuuguuguggacagcaaugauagggaccguguuguugaagca

SEQ ID NO: 8364 - RNA, 73 nt, Zea mays
cgcggcgccggcgggcugcgacgucgcgcagggcgagugggugcgcgacgacgacgcccgcccaugguaccag

SEQ ID NO: 8365 - RNA, 185 nt, Zea mays; identical to SEQ ID NO: 6764

SEQ ID NO: 8366 - RNA, 71 nt, Zea mays
gugaagacaugggcggcgcuggcggcauggacgaggacgcccccgcuggcagcggcggcccuggccccaag

SEQ ID NO: 8367 - RNA, 242 nt, Zea mays
ggccggcgacacggucggcgugggcuacuucgugggguccugccgcuccugcgacagcugcggcaagggggacgacaacuacugcgcggggaucgugcucaccuccaacggcgucgaccacgcgcacggcggcgcgcccaccagggggggauucuccgacguccuggucgcgagcgagcacuacgugguccgcguccccgacggccuggcgcuggaccgcaccgcgccgcugcucucgccgg

SEQ ID NO: 8368 - RNA, 68 nt, Zea mays; identical to SEQ ID NO: 7069

SEQ ID NO: 8369 - RNA, 91 nt, Zea mays; identical to SEQ ID NO: 8317

SEQ ID NO: 8370 - RNA, 100 nt, Zea mays; identical to SEQ ID NO: 6855

SEQ ID NO: 8371 - RNA, 384 nt, Zea mays
  misc_feature (234)..(234): n is a, c, g, or u
acggcuccuucucuguuaaguggcacauuggucaaggacgugcccaacaauauucucaagcacaucauccuggagaacaaugagaacaagccugucacaaacagccgugacacucaggagauacgccucgaacaaggccuucagaugcucaaagauauucaaggaucaugucagcaaaacuuccauccucgacgacuuuugccuuucuaugaaggccgccagaaguugaugcangggauaagagguccaaacagcagcagcuccaaaagcaggucugggacacuaggacccccguuucugucaccggugaacgaccacaggaaccugcuaaugggaagcccaauccguccguaccagauggugucacggcagaggugaaggcgg

SEQ ID NO: 8372 - RNA, 67 nt, Zea mays; identical to SEQ ID NO: 8113

SEQ ID NO: 8373 - RNA, 89 nt, Zea mays; identical to SEQ ID NO: 7136

SEQ ID NO: 8374 - RNA, 73 nt, Zea mays
gggaucccgaggggaagaaauccucuugcuauucaaaauugaauugcaagaugauuccuccccauggaucccc

SEQ ID NO: 8375 - RNA, 69 nt, Zea mays
ggcuucgucaucuggucgcugggauuuucggucuccgaucguuugguucccaguagacucguucccuug

SEQ ID NO: 8376 - RNA, 398 nt, Zea mays
cugcgagggaggagcacaagaccggcggcauccugcaucgcuccggcagcuccagcuccagcucgucggaggacgacggcaugggcggaaggaggaagaagggaaucaaggagaagaucaaggagaagcugcccggaggccacaaggacgaccagcacgccacggcgacgaccggcggcgccuacgggcagcagggacacaccggcagcgccuacgggcagcagggacacaccggcggcuccuacgccaccggcaccgagggcaccggcgagaagaaaggcauuauggacaagaucaaggagaagcugcccggacagcacugagcggcgccuauacguggcugugcugggcugugcuggcgcgucaaagccguaauguucaguguuccauagauaaua

SEQ ID NO: 8377 - RNA, 67 nt, Zea mays; identical to SEQ ID NO: 6720

SEQ ID NO: 8378 - RNA, 74 nt, Zea mays
cuggaagguggggugcuguacucucggaaacauggcgggcaccauggcgagaguaacguguaccaaccaggcca

SEQ ID NO: 8379 - RNA, 75 nt, Zea mays
cgcgcggccguggagagcggcagcccccugguccccaacaggaucagggagugccgguccuacccgcuguaccgg

SEQ ID NO: 8380 - RNA, 76 nt, Zea mays
gcggacuguccggauacguacccggaccguccgugauuauaugcggaccguccgucguuguaugcggaccguccga

SEQ ID NO: 8381 - RNA, 112 nt, Zea mays
auaaguuaucuggaaaauccuguugaguugcucaaugaagcggcaaaagcugcagagaaagaucuauggaaaauccuguugaguugcucaaugaaggcuuuugcgaaucacu

SEQ ID NO: 8382 - RNA, 89 nt, Zea mays; identical to SEQ ID NO: 7136

SEQ ID NO: 8383 - RNA, 96 nt, Zea mays
gugcgcucaacaguaagcaggcuaccguaauuggauucaaggcacuuugguugcucuucaauuaugcgagugcgccuguggacuguaugguucuau

SEQ ID NO: 8384 - RNA, 65 nt, Zea mays
ucaccaacaacugcggcucgacgguguggccggcggccaccccggugggcggcggcacgcagcuu

SEQ ID NO: 8385 - RNA, 248 nt, Zea mays
gcgcacgcggaccucaagcgcugcgucgacuacgcggcggcgugcgaggccgaggaccugcaccuccgcgccgacggcggcgcgggcgccgcccggggcucgcgcggggccacgcgccgccccggcgcgcucaccgugcaguuccccguggggagcccgcugcucgcgcgccugucggugcgggggcucagccucacggccgucaacaacgccauggucgccacgcucgaggucguccaccuccacuc

SEQ ID NO: 8386 - RNA, 71 nt, Zea mays
aucucaucgagcagcuguaugacuacaagaugguugagaaccgaucuguaguggaacaggcucaugaguuu

SEQ ID NO: 8387 - RNA, 106 nt, Zea mays
cagcaccccuccaccguggcucgacggcaggccuucccggcgacuucggcuuugaucccuggggccucggaucugacccggagagccugcgguggaacgugcaggc

SEQ ID NO: 8388 - RNA, 72 nt, Zea mays; identical to SEQ ID NO: 7065

SEQ ID NO: 8389 - RNA, 99 nt, Zea mays
auacgcauuuguucaggugaagcugguagccgugcaacuuggaguaccaggacgaguuggugcuguggacggagagcggcgacgugggcaagggcuuca

SEQ ID NO: 8390 - RNA, 69 nt, Zea mays
aaccaacuagugaaauagugucgcgugucuuggauccagauggugaugcgaguugacacaaaugauuua

SEQ ID NO: 8391 - RNA, 100 nt, Zea mays; identical to SEQ ID NO: 6981

SEQ ID NO: 8392 - RNA, 220 nt, Zea mays
ccaauguagaugcuuuccgaguagauggagcuuuugauguuaacuccaagaaugauauaucuauucaugauuaucuuccagcaaugaaagccauaugugauaaacuugaagaagcaagcaaaaagguugaccacucucacauuuuccccauugaagcuauguuggcucuuauuuugucaaauauaaaaguucaucucgacuacaggauguuacaagauuc

SEQ ID NO: 8393 - RNA, 99 nt, Zea mays
cagcagcaccuccugggccauggcgccgccgccggcaagcagggcgcuggcggcaacggccacggcggcgguggcaguggccuugcggagagaggcacg

SEQ ID NO: 8394 - RNA, 141 nt, Zea mays
cggccuagcgcaccgccgugagcccgcugcugcggggcguccaggucggccucgcgcacggcgaccuccugcguggggccuugcgcgccaacggcccgcuccucagcaacgcccgugcacggccaggccggcgcgcucggc

SEQ ID NO: 8395 - RNA, 106 nt, Zea mays
uuugugugcgugccuggcucccuguaugccacacauguagcgcccaaccuagaugcuaagguugccugcuguggguggcgugcaaggggccaagcaugcauccaug

SEQ ID NO: 8396 - RNA, 84 nt, Zea mays; identical to SEQ ID NO: 8046

SEQ ID NO: 8397 - RNA, 81 nt, Zea mays; identical to SEQ ID NO: 6702

SEQ ID NO: 8398 - RNA, 172 nt, Zea mays
cgccggcguggccguccgacugcugcugccaccacggccacggcggcugccacugcugcuccugcggcaagggcccccgaggccccggcgccgcccccgaugccgcaguacgugccccagccguaccccugcaaccccugcggcggcggcuaccggaucgucugcgaggagg

SEQ ID NO: 8399 - RNA, 161 nt, Zea mays
ucuuuaguugucguuuagggguagcuuuggaacuuuauuuuuucaaaggauuucuauuuuuuuaaaggaaaaugaacuaauuuucuuuugaauaauuuucuuuugaaaaaugagaaccuuuggaaaaauggguucacaaacuaaccuuuaaccuuuuuuuu

SEQ ID NO: 8400 - RNA, 75 nt, Zea mays
uggagcuccaacggcuccuagcuaccuuggggcuauaaaaagaaccccuaggugcauggagcaguaccccaagcc

SEQ ID NO: 8401 - RNA, 113 nt, Zea mays
cacggaauccaggcucugguggugccguauuugcagugagguugcccucuuccaaguggcacccaaaaaugcuccauucaagcagcugaccaccgagaaccugagguuccugu

SEQ ID NO: 8402 - RNA, 268 nt, Zea mays
uuguuaaucgggaacauaucuggugcaaaucaacuccucugugcaaacaugcaaacuuuugauuuaggccacaugauguugauaaaauggacaaaggggcguagauaauuuuacacuuaaccacccacuacuaaucacacuuuuucaaaucccccucccacuccccccgcacggcuccuuggaccaacauuaugugguucagauuauaaguuuucacgguuacgcggaggaguuguuuugcagcagauauguucccuuguuaaucaac

SEQ ID NO: 8403 - RNA, 62 nt, Zea mays
uauuuuaaaaacuuuuaucacuuauaugcugcauuaggugauaggaguugugugaauaaaca

SEQ ID NO: 8404 - RNA, 117 nt, Zea mays; identical to SEQ ID NO: 7116

SEQ ID NO: 8405 - RNA, 123 nt, Zea mays
guuuaguuccuucauuuuguuccauuuuaguauauaaauugauaaauauagaaacuaaaauagaguuuuaguuucuauauuugauaauuuuguaacuaaaguggaauaaaauguagggacuaa

SEQ ID NO: 8406 - RNA, 77 nt, Zea mays
ggccccggcgccgcguccuuccacgccguccucgacgacccggagcccgacgacaagaaggcgcaggcgccgccccg

SEQ ID NO: 8407 - RNA, 230 nt, Zea mays
ccaucgccgccggcggcggccuugccgaccuccuccuccugucccucugucgcggcgcaggagcagcuggugcugcugccggaacggaaacuguagcgguugccgcugcugcccugccggcgcguggcgccggcggggguggggguugagcagcugcugguagaccgggaaaagugacguacuccauggcggugggugggagcggcaggagcggcgguugguuggacggu

SEQ ID NO: 8408 - RNA, 232 nt, Zea mays
uacaugacaaucucgaugcaugcuacacgucucugcguacuaaugugaaacuagaucaaaucuuggcacguuuaggagccagugucccugcccaggccaucgauaggucgacuccauguuguauauuggcuagcucuguagcuuggcucacuggcucuuaaacgugggaaggcuugaucuaguuugagauuggugcacaagggcauguggcauggaucaagaucguacuaua

SEQ ID NO: 8409 - RNA, 21 nt, Glycine max
ugcucugcaugguugugguga

SEQ ID NO: 8410 - RNA, 21 nt, Glycine max
gaguucccugcacuccaaguc

SEQ ID NO: 8411 - RNA, 20 nt, Glycine max
ugcacugccucuucccuggc

SEQ ID NO: 8412 - RNA, 20 nt, Glycine max
gggaaggcauggguaugggg

SEQ ID NO: 8413 - RNA, 21 nt, Glycine max
gagcucucuacacuccaaguc

SEQ ID NO: 8414 - RNA, 21 nt, Glycine max
gacgacgauggagauggugga

SEQ ID NO: 8415 - RNA, 21 nt, Glycine max
cgcuauccauccugaguuuca

SEQ ID NO: 8416 - RNA, 21 nt, Glycine max
uuccacagcuuucuugaacug

SEQ ID NO: 8417 - RNA, 21 nt, Glycine max
cuccuacuagccucggucgcc

SEQ ID NO: 8418 - RNA, 20 nt, Glycine max
ugacagaagagagugagcac

SEQ ID NO: 8419 - RNA, 21 nt, Glycine max
ugagaauuuggccucugucca

SEQ ID NO: 8420 - RNA, 21 nt, Glycine max
ugauugagccgugccaauauc

SEQ ID NO: 8421 - RNA, 21 nt, Glycine max
uugcugauguuguugaggcac

SEQ ID NO: 8422 - RNA, 20 nt, Glycine max
gcauaccccaacggcuucau

SEQ ID NO: 8423 - RNA, 20 nt, Glycine max
gagcucgaauuucccguugu

SEQ ID NO: 8424 - RNA, 21 nt, Glycine max
ugacuuauuagguguugauuu

SEQ ID NO: 8425 - RNA, 22 nt, Glycine max
uuccaaagggaucgcauugauc

SEQ ID NO: 8426 - RNA, 21 nt, Glycine max
uugagccgcgucaauaucuca

SEQ ID NO: 8427 - RNA, 21 nt, Glycine max
ucggaccaggcuucauucccg

SEQ ID NO: 8428 - RNA, 21 nt, Glycine max
acaacagugagucacaaacga

SEQ ID NO: 8429 - RNA, 20 nt, Glycine max
cccugcacuugcaagugagg

SEQ ID NO: 8430 - RNA, 22 nt, Glycine max
gcgaugaagcucuacguuucga

SEQ ID NO: 8431 - RNA, 23 nt, Glycine max
ucauguaauguucguccuccagu

SEQ ID NO: 8432 - RNA, 21 nt, Glycine max
ccaccuggccgaaccauuccg

SEQ ID NO: 8433 - RNA, 21 nt, Glycine max
uguguccgugucaguguccga

SEQ ID NO: 8434 - RNA, 23 nt, Glycine max
ugcgacuauuccucaagcacgcc

SEQ ID NO: 8435 - RNA, 23 nt, Glycine max
ggcucgugcggaucguguugguc

SEQ ID NO: 8436 - RNA, 24 nt, Glycine max
guccaaccgggauuugguaccuaa

SEQ ID NO: 8437 - RNA, 22 nt, Glycine max
ucacaucucuuccauugguuac

SEQ ID NO: 8438 - RNA, 24 nt, Glycine max
ucuccaacguguccucgaagucgu

SEQ ID NO: 8439 - RNA, 21 nt, Glycine max
cgcauccgcaggcacucgcgc

SEQ ID NO: 8440 - RNA, 21 nt, Glycine max
cugaggagcacucuugacggu

SEQ ID NO: 8441 - RNA, 21 nt, Glycine max
ugagauggagaagccccgugc

SEQ ID NO: 8442 - RNA, 21 nt, Glycine max
cgugagugcggagccgguggg

SEQ ID NO: 8443 - RNA, 21 nt, Glycine max
uaaaaucaacuuaugcacuuc

SEQ ID NO: 8444 - RNA, 22 nt, Glycine max
uagaacccagcucuacuauuga

SEQ ID NO: 8445 - RNA, 22 nt, Glycine max
uuagauucacgcacaaacuugu

SEQ ID NO: 8446 - RNA, 21 nt, Glycine max
ccgauggugugaaugcuaagc

SEQ ID NO: 8447 - RNA, 21 nt, Glycine max
uaauucacacauuuggucccc

SEQ ID NO: 8448 - RNA, 22 nt, Glycine max
cuucucaaggaagcuaccuagu

SEQ ID NO: 8449 - RNA, 21 nt, Glycine max
ugcggcaacggcugcggaggc

SEQ ID NO: 8450 - RNA, 21 nt, Glycine max
uagaucuacacuuguucuugc

SEQ ID NO: 8451 - RNA, 21 nt, Glycine max
ggaggucguagacggcgucgg

SEQ ID NO: 8452 - RNA, 23 nt, Glycine max
uaagcuaugagaucugagggcuu

SEQ ID NO: 8453 - RNA, 24 nt, Glycine max
uuaauguuguggucguguugugca

SEQ ID NO: 8454 - RNA, 21 nt, Glycine max
uggacugaagggagcuccuuc

SEQ ID NO: 8455 - RNA, 20 nt, Glycine max
cuccacuugaacugauccac

SEQ ID NO: 8456 - RNA, 21 nt, Glycine max
uaguccaucgacaagccucga

SEQ ID NO: 8457 - RNA, 21 nt, Glycine max
ccaauguuaaaugugacaugu

SEQ ID NO: 8458 - RNA, 21 nt, Glycine max
ccaccagcacgcucaccacgu

SEQ ID NO: 8459 - RNA, 22 nt, Glycine max
ugcugcuguggcugugcugugc

SEQ ID NO: 8460 - RNA, 23 nt, Glycine max
uccagcguguugcugcuguccag

SEQ ID NO: 8461 - RNA, 24 nt, Glycine max
uaacggucaacauccaauuguggc

SEQ ID NO: 8462 - RNA, 20 nt, Glycine max
ccauucagaucuguuucgca

SEQ ID NO: 8463 - RNA, 21 nt, Glycine max
uuuuuaccagcugaccggaga

SEQ ID NO: 8464 - RNA, 20 nt, Glycine max
gcaggagugcgugucggagu

SEQ ID NO: 8465 - RNA, 21 nt, Glycine max
cuauugagggauuggcucuga

SEQ ID NO: 8466 - RNA, 20 nt, Glycine max
auggccuuggucagcguugu

SEQ ID NO: 8467 - RNA, 21 nt, Glycine max
ucgccguggcacccuucuugc

SEQ ID NO: 8468 - RNA, 21 nt, Glycine max
uaugggauaaaugugagcuca

SEQ ID NO: 8469 - RNA, 21 nt, Glycine max
augacaaucuauuuuccuucc

SEQ ID NO: 8470 - RNA, 25 nt, Glycine max
uccgaucucccucuucgugucgcuc

SEQ ID NO: 8471 - RNA, 21 nt, Glycine max
ucgugaugaaucccuugagcu

SEQ ID NO: 8472 - RNA, 20 nt, Glycine max
gaauaugguccuguuagcga

SEQ ID NO: 8473 - RNA, 25 nt, Glycine max
auugugccgccuuuggacauuucca

SEQ ID NO: 8474 - RNA, 21 nt, Glycine max
gggcaucuacaacuugcagca

SEQ ID NO: 8475 - RNA, 24 nt, Glycine max
ugcaguacuaugacuuuggugguu

SEQ ID NO: 8476 - RNA, 20 nt, Glycine max
ccuccuugccaucauucucc

SEQ ID NO: 8477 - RNA, 21 nt, Glycine max
cgaucgagagguuccgcgcca

SEQ ID NO: 8478 - RNA, 24 nt, Glycine max
cgccuuaaacgguccucuuugcuu

SEQ ID NO: 8479 - RNA, 25 nt, Glycine max
cauguggccgccgagggcuugugcu

SEQ ID NO: 8480 - RNA, 21 nt, Glycine max
acauaaugaaggcagcauggu

SEQ ID NO: 8481 - RNA, 20 nt, Glycine max
cugcugauccgacaaguccc

SEQ ID NO: 8482 - RNA, 24 nt, Glycine max
cuucaucaauggaguccuuugcuu

SEQ ID NO: 8483 - RNA, 24 nt, Glycine max
auagacaagcguaccuguugcauu

SEQ ID NO: 8484 - RNA, 23 nt, Glycine max
ccuggcucaucgacacaugaggu

SEQ ID NO: 8485 - RNA, 24 nt, Glycine max
gcugcugguaacuauccugagugg

SEQ ID NO: 8486 - RNA, 20 nt, Glycine max
cggugcucccguauacuugg

SEQ ID NO: 8487 - RNA, 20 nt, Glycine max
augcuaccacuuguucugcu

SEQ ID NO: 8488 - RNA, 24 nt, Glycine max
cacuuccacaauugacuugaaucu

SEQ ID NO: 8489 - RNA, 22 nt, Glycine max
gguguuggaugucccgguuccu

SEQ ID NO: 8490 - RNA, 22 nt, Glycine max
accaucuacgagguccugagcg

SEQ ID NO: 8491 - RNA, 21 nt, Glycine max
ugggacucucugaucuuggau

SEQ ID NO: 8492 - RNA, 24 nt, Glycine max
cgcaucuugccuugaagguuggcg

SEQ ID NO: 8493 - RNA, 22 nt, Glycine max
uuaagcuaugagaucugagggc

SEQ ID NO: 8494 - RNA, 20 nt, Glycine max
cacuagagaugugcuuagug

SEQ ID NO: 8495 - RNA, 20 nt, Glycine max
cacuguugacaagcuaucau

SEQ ID NO: 8496 - RNA, 23 nt, Glycine max
ggggcugcaagaggauuggaaua

SEQ ID NO: 8497 - RNA, 21 nt, Glycine max
ggacacuuauggaacugggaa

SEQ ID NO: 8498 - RNA, 22 nt, Glycine max
auccacagcaggcucaggaggu

SEQ ID NO: 8499 - RNA, 21 nt, Glycine max
cagaggagcacuguguucugu

SEQ ID NO: 8500 - RNA, 20 nt, Glycine max
cccgguccuuucgguuccgg

SEQ ID NO: 8501 - RNA, 21 nt, Glycine max
uggcugcucaaaacuugguug

SEQ ID NO: 8502 - RNA, 21 nt, Glycine max
uuauacacuggaggcuuguaa

SEQ ID NO: 8503 - RNA, 20 nt, Glycine max
acggauuguuagugcugugg

SEQ ID NO: 8504 - RNA, 24 nt, Glycine max
ugccgaggaaaacgaggaaggacc

SEQ ID NO: 8505 - RNA, 23 nt, Glycine max
cgccggaaagcaacuugaggacg

SEQ ID NO: 8506 - RNA, 21 nt, Glycine max
ucgcagguucgugcgugaauc

SEQ ID NO: 8507 - RNA, 20 nt, Glycine max
cguggagcggcaugggccca

SEQ ID NO: 8508 - RNA, 21 nt, Glycine max
acuaccucugcauugaaacuc

SEQ ID NO: 8509 - RNA, 20 nt, Glycine max
caugggcguuucugucuuuc

SEQ ID NO: 8510 - RNA, 20 nt, Glycine max
caacgcuuggacuuguaugc

SEQ ID NO: 8511 - RNA, 21 nt, Glycine max
uuuggacugaagggagcuccu

SEQ ID NO: 8512 - RNA, 21 nt, Glycine max
cguaguggcuggcaaauugua

SEQ ID NO: 8513 - RNA, 21 nt, Glycine max
ggcauuccaguuggcauuucu

SEQ ID NO: 8514 - RNA, 20 nt, Glycine max
caauacugacgacaaaucga

SEQ ID NO: 8515 - RNA, 21 nt, Glycine max
ccaaucugauccuuggccuga

SEQ ID NO: 8516 - RNA, 20 nt, Glycine max
cgucggcagugcugggacgu

SEQ ID NO: 8517 - RNA, 21 nt, Glycine max
ggccuagggcagugaccucca

SEQ ID NO: 8518 - RNA, 20 nt, Glycine max
cggauguccgauuuaggcgc

SEQ ID NO: 8519 - RNA, 21 nt, Glycine max
uugugacaaggauccuacuuc

SEQ ID NO: 8520 - RNA, 20 nt, Glycine max
uguugcagcaacugguguua

SEQ ID NO: 8521 - RNA, 20 nt, Glycine max
gagaagcugaccgggcaacg

SEQ ID NO: 8522 - RNA, 24 nt, Glycine max
auucaaggcgcuuugcauccagug

SEQ ID NO: 8523 - RNA, 22 nt, Glycine max
cuccuucggcuccaugccaacc

SEQ ID NO: 8524 - RNA, 21 nt, Glycine max
cgugguuucagaggaacagaa

SEQ ID NO: 8525 - RNA, 20 nt, Glycine max
ugcuguugguguugggcuca

SEQ ID NO: 8526 - RNA, 20 nt, Glycine max
ucaugcgaucccuuaggaac

SEQ ID NO: 8527 - RNA, 22 nt, Glycine max
gcucaggcgucguguugaagau

SEQ ID NO: 8528 - RNA, 20 nt, Glycine max
agcuaugagaucugagggcu

SEQ ID NO: 8529 - RNA, 21 nt, Glycine max
gauccuuagguuugcagguuc

SEQ ID NO: 8530 - RNA, 25 nt, Glycine max
ugguggcgguggauaugguggucgu

SEQ ID NO: 8531 - RNA, 21 nt, Glycine max
ucgccgccguguccagcgccg

SEQ ID NO: 8532 - RNA, 22 nt, Glycine max
uagucguagugaucguguugcu

SEQ ID NO: 8533 - RNA, 21 nt, Glycine max
cuugcuugugcuguauuuggu

SEQ ID NO: 8534 - RNA, 22 nt, Glycine max
caauuugcagagcaagggcguc

SEQ ID NO: 8535 - RNA, 20 nt, Glycine max
cccgacagguucugaucgcu

SEQ ID NO: 8536 - RNA, 21 nt, Glycine max
cagccaaggaugacuugccga

SEQ ID NO: 8537 - RNA, 20 nt, Glycine max
cgcuauccauccugaguuuc

SEQ ID NO: 8538 - RNA, 21 nt, Glycine max
ucgcuuggugcaggucgggaa

SEQ ID NO: 8539 - RNA, 21 nt, Glycine max
ucggaccaggcuucauucccu

SEQ ID NO: 8540 - RNA, 20 nt, Glycine max
uuggacugaagggagcuccc

SEQ ID NO: 8541 - RNA, 22 nt, Glycine max
uuaaucaaggaaaucacggucg

SEQ ID NO: 8542 - RNA, 21 nt, Glycine max
uguuguuuuaccuauuccacc

SEQ ID NO: 8543 - RNA, 21 nt, Glycine max
ugccuggcucccugcaugcca

SEQ ID NO: 8544 - RNA, 21 nt, Glycine max
uagaaagggaaauagcaguug

SEQ ID NO: 8545 - RNA, 21 nt, Glycine max
ucgauaaaccucugcauccag

SEQ ID NO: 8546 - RNA, 22 nt, Glycine max
uucccaauuccgcccauuccua

SEQ ID NO: 8547 - RNA, 21 nt, Glycine max
caggaauugcaugugcuuggu

SEQ ID NO: 8548 - RNA, 21 nt, Glycine max
cagccaaggaugacuugccgg

SEQ ID NO: 8549 - RNA, 22 nt, Glycine max
uuaaucaaggaaaucacgguug

SEQ ID NO: 8550 - RNA, 21 nt, Glycine max
uugacagaagauagagagcac

SEQ ID NO: 8551 - RNA, 21 nt, Glycine max
uagaagcuccccauguucuca

SEQ ID NO: 8552 - RNA, 21 nt, Glycine max
ugauauccuugagcuaauaca

SEQ ID NO: 8553 - RNA, 21 nt, Glycine max
ugaagcugccagcaugaucug

SEQ ID NO: 8554 - RNA, 21 nt, Glycine max
uagaggcuccccauguucuca

SEQ ID NO: 8555 - RNA, 21 nt, Glycine max
uacgggucgcucucaccuagg

SEQ ID NO: 8556 - RNA, 21 nt, Glycine max
ucggaccaggcuucauucccc

SEQ ID NO: 8557 - RNA, 21 nt, Glycine max
ucuugaagccaugguuauuaa

SEQ ID NO: 8558 - RNA, 22 nt, Glycine max
ucucauuccauacaucgucuga

SEQ ID NO: 8559 - RNA, 20 nt, Glycine max
uuggcauucuguccaccucc

SEQ ID NO: 8560 - RNA, 22 nt, Glycine max
ugaugacugucacgugucaugu

SEQ ID NO: 8561 - RNA, 239 nt, Glycine max
uuaauuaauuggcgugcuugaggaauagucgcagccauacccaaccgaaaaaguauguuauccaagcgcauuucaaguaguuguaauaaaaccugaccaguugauccuuuagcuuuuccggcgauacgaacguauuuaagcaauugucguucuguaagaccauaaugaaaacgcaauuuuuguuuuucuucuaaacgaauacgauauugagauuuuuuacuggagcgcgauugauuucu

SEQ ID NO: 8562 - RNA, 102 nt, Glycine max
acauagaaauugacagaagagagugagcacacagaggcacuugguauaguauauauacuauugcuuuugcgugcucacuucucuuucugucaacuuccagug

SEQ ID NO: 8563 - RNA, 99 nt, Glycine max
acagaguuuauuggcauucuguccaccuccacuuccuacucucucucugagccacauguucgugaaguuggaggugggcauacugucaacugaguucug

SEQ ID NO: 8564 - RNA, 128 nt, Glycine max
caaagccuuuugcuccaggacccauauuuuuuuggaaggaugauggaccuuugccaccauuggccauggaguaaagaaggccccauccuaagggugaagaauaugguccuguuagcgaauuuuacguc

SEQ ID NO: 8565 - RNA, 90 nt, Glycine max
augcagaaaugggaguuccuugcagcccaaagcuucaaggaugaaauucuuccugcgguuuuggacugaagggagcuccuacuucuucac

SEQ ID NO: 8566 - RNA, 130 nt, Glycine max
cacaaagacuuaugcuacaagaaccauauuuuucuugaaagaugauggaacuuugacaccauuggccauugaguuaaguaagccacauccucagggugaagaauaugguccuguuagcgaagucuacgug

SEQ ID NO: 8567 - RNA, 490 nt, Glycine max
cucuuuaauuuaauucacacauuugguccccccaauuuuauaaaucccuuuauaaauuguuccuacaaaauuggucuuuugaaugguuuagccacugguacuagagacaugauagaccuugauaaauuuugcacuccuuuuuuaucgcaaguuuuucacucacuuggaacccagagaaaaaucacucuuuaucucucucccaauuucgggguuauucaacuugagaaaguggcguaugaaucccagccuagguccgaaauuuucaaaucucuugcuuuaacagguuuuguaauaacccccccccccccuuuuuuuuucguuuuuugcucccccaugugguauuauguguauacgacuuaaguggucuauguaugacaaugauauuuuuguuugaaauuugaaauacgacuucuccaguaaugaaauuugguugaauuuauaaaggaauuuacaaaacugagggaccaaaugugugaauuaaauuauaagg

SEQ ID NO: 8568 - RNA, 69 nt, Glycine max
ucaagaggcggcgaugaagcucuacguuucgaagagcgaguucgagaagguucacuuguugcaggcgau

SEQ ID NO: 8569 - RNA, 125 nt, Glycine max
ucuuauuggaugaugacugucacgugucauguucuaauuaguuaaugaaaacaacaauaagaacaucuuuuauggaguugacauucauucagaacaugauaugcggcaguuaucauccaauaaga

SEQ ID NO: 8570 - RNA, 250 nt, Glycine max
  misc_feature (216)..(216): n is a, c, g, or u
cucucaaaucauaauugaacguuaaucguuaacaaguaaugcugaguguuaugugucacauucuuauuggaugaugacugucacgugucauguucuaauuaguuaaugaaaacaacaauaagaacaucuuuuauggaguugacauucauucagaacaugauaugcggcaguuaucauccaauaagaacaugaaauaugaccaucaauaucacucgnuaacggucaacauccaauuguggcuuggggaauc

SEQ ID NO: 8571 - RNA, 100 nt, Glycine max
auaauuauuugauguuggcuuggcucaaucaaauuaaaauuuuuaaagauuuuguuaacuuuuuugaucugauugagccgugccaauaucauauucaucu

SEQ ID NO: 8572 - RNA, 128 nt, Glycine max
auacuuacgauggacgcuacuggaccauguggaagcugacuaugguugguugcacugaugcuucugauguguggaaagagcuucgagaggcuaagacugcauaccccaacggcuucauccguaucauc

SEQ ID NO: 8573 - RNA, 176 nt, Glycine max
uugggguugaugggaauguuguuuggcucgagguaacuaugcauggucuuaauuuuguucaucuuugaagcuuuaauuuauggguuucgaucucuuugaucccuugaaacaaagaaagcuuuaaagguuggauuuugaggcuuucucggaccaggcuucauucccguaaaccuuau

SEQ ID NO: 8574 - RNA, 102 nt, Glycine max
ucuuguaaguuaaaaucaacuuaugcacuucaacuuuuagaaaaguuagauaaaagagcuucuauaaaaguuaagcgcacaaggugauuuuaacuuaugaga

SEQ ID NO: 8575 - RNA, 130 nt, Glycine max
gaguguagugcagccaaggaugacuugccggcauuagccaagugaaugagcaucauauauauauauauauauauauauauauauaugacucauguucuugucggcaaguuggccuuggcuauauuggacu

SEQ ID NO: 8576 - RNA, 69 nt, Glycine max; identical to SEQ ID NO: 8568

SEQ ID NO: 8577 - RNA, 130 nt, Glycine max
cacaaagacuuaugcuaccagaaccauauuuuucuugaaaagugauggaacuuugacgccauuggccauugaguuaaguaagccgcauccucaaggugaagaauaugguccuguuagcgaagucuacgug

SEQ ID NO: 8578 - RNA, 108 nt, Glycine max
  misc_feature (53)..(53): n is a, c, g, or u
ggucucuaauucgcuuggugcaggucgggaaccgguuuucgcgcggaauggangagcggucgccggcgccgaauuggaucccgccuugcauccacugaaucggaggcc

SEQ ID NO: 8579 - RNA, 91 nt, Glycine max
uaaauuuucuugagaauuuggccucuguccaugucuaauuauuaauuccaauaauucagauggacagagcccaaauucucaagagaauuug

SEQ ID NO: 8580 - RNA, 85 nt, Glycine max
uugcaaguaacacuuccacaauugacuugaaucugauuggagagaagacaaagucucaagaucgaauuguuggagcccauuucuu

SEQ ID NO: 8581 - RNA, 107 nt, Glycine max
gaggaucagguagaacccagcucuacuauugaacaugacugcuguaaugaugaauauaguacaacuggugcugaggaucagguagagcucagcucuacuauugaaca

SEQ ID NO: 8582 - RNA, 111 nt, Glycine max
cugcaucuucuuaaucaaggaaaucacggucgcgugugugccggaaagaaaguggccugugaucuccgguuucucuuucucgaccguguuuccuugguuaacgauaugugc

SEQ ID NO: 8583 - RNA, 145 nt, Glycine max
aaaaacgugaaguagagggaucccauccugacggaugagcugcucccucccccgguuaacuaccacuacccggucuucccuuugaauugauagcuuccgcuggagcacuugccuucgugaugaaucccuugagcuuugacuaucu

SEQ ID NO: 8584 - RNA, 69 nt, Glycine max
uugggaaucauugcugauguuguugaggcacuaauuggugccuuuauuagcacagaagaugaaaaggcu

SEQ ID NO: 8585 - RNA, 170 nt, Glycine max
uucuggauuauuaauguuguggucguguugugcaggggacaauuaucugaaaccguauguaauuucggaaccggagguaacgguaacggagcggagugacaaggaugaguguuugauacuagggagcgaugggcuuugggacacggugcagaacgacaccgcauguaagg

SEQ ID NO: 8586 - RNA, 116 nt, Glycine max
aauuggggguuuauacacuggaggcuuguaaacccccaauugaaaaaccacccguuuauaagacucuaguauacaagcuagcaguguacaagccuccaguguauaagccaccaguu

SEQ ID NO: 8587 - RNA, 91 nt, Glycine max
uauggaacuggagggauagguaaaacaacgaccgcuguagaaguaauuguuauaguuaguuguuguuuuaccuauuccacccauuccaugu

SEQ ID NO: 8588 - RNA, 107 nt, Glycine max
cuaagggagaugacagaagagagugagcacacaugguauuuucuugcacgaugacgauucaugcuugaagcuaugugugcuuacucucuaucugucaucccaucacc

SEQ ID NO: 8589 - RNA, 98 nt, Glycine max
cgagugauuucgcauccgcaggcacucgcgcagugcgagcacacucucaccaaacucggccugaacguggcgcgcgaggccguggacgacaccgccgg

SEQ ID NO: 8590 - RNA, 105 nt, Glycine max
acauuacuggagcuggcuguugcugggugggcuguugcuccugaagugaagaaugagcauuaggaggcauugacugcauaccccaacggcuucauccguaucauc

SEQ ID NO: 8591 - RNA, 83 nt, Glycine max
uugugcaaguuuccuaugccauuggugucccugagcccuugucaguguuuguggacacuuauggaacugggaagauuccugac

SEQ ID NO: 8592 - RNA, 99 nt, Glycine max
augaaaaccgacagaaagaguagugagcacacaaaagcagugauauagauuuauaucaagugccucuuugugcucacucucuucugucaauuucugucc

SEQ ID NO: 8593 - RNA, 109 nt, Glycine max
gguugugccacaguucugccaguucacgcgagguagcuuuuugguuuagcuucuuuaagucuuuacuuaggugagcugcguaguggcuggcaaauuguaaguaagaaag

SEQ ID NO: 8594 - RNA, 100 nt, Glycine max
gaagaaucuguaaagcucaggagggauagcgccauggaugaucucuucuccacucuugaucuucucuugcgcuauccauccugaguuucauggcuucuau

SEQ ID NO: 8595 - RNA, 262 nt, Glycine max
gaggagaauuauugugccgccuuuggacauuuccagcuuuuccagaagauggagucaagcuaaacaauugaggaagcuuuaaagugggaggacuaacagaaaccuugucaagcugaauauuagauauucuagaagucaccucacuaacaucaucagugcuauuguccauccucccacuacucugugucuggauaggugacguugaucgaccauuaggucuguucauuggagguagauuggaggcuauacaguuaaccuuuuc

SEQ ID NO: 8596 - RNA, 350 nt, Glycine max
  misc_feature (346)..(346): n is a, c, g, or u
gcauagacauccuccuugccaucauucucccuccucuuggagucuuucucaaauauggcugccagguacuaaauugcacauauuuuucuuuucagaauuaaagauuuuuacacaaaaaauugguuacuuuuuuucauugcauguuaauggauuguagaguguggugacuaauacaacacaugguuaauggaaaugguaaugguaauaguaauuaauuuauguaaauacagauggaguugguaauugauguaagaggggagggauuggaagggauacggaggggguguguaggaaauauagugguaagaaggggugagguugggagugugggggaaggggggugganugga

SEQ ID NO: 8597 - RNA, 156 nt, Glycine max
cacgucuugaggggaaugcagugugguccaaggagaugauauaucacuucaccauacucauaucuucacaaacucaucagauucagauguaauaauaauuuguaauauaugcauauuaugucuccucggaccaggcuucauucccuucaauuacag

SEQ ID NO: 8598 - RNA, 184 nt, Glycine max
gguaagagagcuuucuucaguccacuuaugggugacaauaagauuucaauuagcugccgacucauucauccaaaugcugagugaaagcgaagaaagauacucagcaaaugagugaaugaugcgggagacaaauugauucuuaaguuuccuguacuuggacugaagggagcucccuuuuucuuuu

SEQ ID NO: 8599 - RNA, 206 nt, Glycine max
agcagaaaaagaaggagcucccuucaguccaagcacagagaaagaggguuccaauauagauacuauauacucccgcuucauucacacaauauuacccuaauugaauacuauuguaugaaugaaugugugagcuagcaguuaauucagcaacccaaucuuucguuaucuccaugaaugggcugagggaagcuccuucacucucuuuc

SEQ ID NO: 8600 - RNA, 289 nt, Glycine max
uuuuauaaaaucauguaauguucguccuccaguccacacuugaaccuuaacggguuacaaggugacguugauuauugucacgugucacuuuuuuauugaaugaugacuuucacgugucauguuuugaugggucaaugaaaacaacaauguauuucaucuuuuauggaauuaacauccacaugauacgugacaaucaucauucaauaagaaagugacacaugguagucaaugucacuuuguaacaaucaacguccaauuguggguugagggaccaacauugcaugauuuu

SEQ ID NO: 8601 - RNA, 148 nt, Glycine max
aaaucuccaucaggguuuggauaagggauugggaugacagaucugugauaaacauugagugcuccaaacccuccagcugcuuuaugcaguugaguugauggaaaguauguauaugugccaaucugauccuuggccugaaacuuguaug

SEQ ID NO: 8602 - RNA, 84 nt, Glycine max
gucaacucuucgugguuucagaggaacagaaguuagagugggcagauuuguuuuucauguucacuuugccaccaaacaagagga

SEQ ID NO: 8603 - RNA, 129 nt, Glycine max
auuaagguuguugacagaagauagagagcacagaugaugauaugcauauuauauaaaaagcagcuagggaacucaugaauugugcaucucacuccuuugugcucucuauacuucugucaucacccuuca

SEQ ID NO: 8604 - RNA, 207 nt, Glycine max
uuggcugcagugcucugcaugguuguggugagugcacccauggcacaugcagcuaucacaugcagacaaguaacaaauagccuaaucaauuacaucauuuaccuccagaacagaagaacaccgccaucagaaugcugcaacagagugaagauccucaaugccgccaccaagaccaccaccaaccaccauacagcauacaacuaccuc

SEQ ID NO: 8605 - RNA, 220 nt, Glycine max
ugggaaauuugguucugucuuuuuuuuuuuugguggugagucgccaauggaagguggaaugauuuuuuagugaaaaaaagcuucucaguauuucucaaaguagcuuucaaagguucuccauauuauuauuacuauuaaaauaaaaaagaauucccuuuucuuuucuucuaauuuuaaagauuuaacugccgaggaaaacgaggaaggaccagauacgaga

SEQ ID NO: 8606 - RNA, 99 nt, Glycine max; identical to SEQ ID NO: 8563

SEQ ID NO: 8607 - RNA, 122 nt, Glycine max
cagggucuagauggccuuggucagcguugugccaaguacuacgaagcuggugcacguuuugccaaauggcgugcagugcugaagauuggucccaacgagccaucugagcugucuauccauga

SEQ ID NO: 8608 - RNA, 115 nt, Glycine max
cuucauuuuggggacuugucggaucagcagaaagacaaagugcuaaacgcacaagucaaaaucgaaagggccauugagaaagcucugcucuccgacggguauucccgggaugagc

SEQ ID NO: 8609 - RNA, 183 nt, Glycine max
uaugaugcugcagccaaggaugacuugccgauaaauucuuucucuaauuugacuuucaauucauguuugucaauugauagugcauuaguucuaauauaugcauuugauuauauagaacacuauugugaaagugucuuuagggauaggguaaauucggcaagucaucuuuggcuacaugucuau

SEQ ID NO: 8610 - RNA, 73 nt, Glycine max
gagagggcauuccagcguguugcugcuguccagaagacuauagggagugcaguagcugcugggagccuaauca

SEQ ID NO: 8611 - RNA, 106 nt, Glycine max
uugguauugaggggaauguuggcuggcucgaggcuuuucacaaaugagguucacaguggauggaacuauaaggcuucggaccaggcuucauuccccucaaaaguuc

SEQ ID NO: 8612 - RNA, 59 nt, Glycine max
cuacugaggaacaacgggaaauucgagcucauagaguucaauucccguucucaacccau

SEQ ID NO: 8613 - RNA, 405 nt, Glycine max
uucuuggcgcuguuugauuuguugcugaaaaacgugguuuuauuuuucuuaaaauucuuuugcacaugcgaauauucugagucugugaugaagauuuaucugugccggaggcgagugauauguuuugcucgucgaugacggcgcaauuccucuaagaaguucugagcucaacauucaaccuuugauugguauuuguaguguuuuguaaauuaucuauguuuguuuuugauuuucuguuaauuuggagauucucaaauuuguugagaauaauuuaaauguuaauuggguuugguuaagagggaaaaguuaagcgaggugaugauagcaauucauuugucugucaauccgcugauuucgugugauguacuaaugaaucccgacagguucugaucgcuaaaaaaaaaa

SEQ ID NO: 8614 - RNA, 154 nt, Glycine max
gcuaucucuuuucaauucuuuauguauugucuucuaauaauggucaucuaauguuuaauaugcagauauuucuccuggcaagaaagaacuugacuggaacacaaggaugaaaauagcugcuggggcugcaagaggauuggaauauuugcaugac

SEQ ID NO: 8615 - RNA, 668 nt, Glycine max
uccguggagggcguggcagccucucucuccguggacauggggauccgaaagggcaacgugguccucauccucucccccaacuccauccacuuccccguugugugccuggccgucaugucccucggcgccaucaucaccaccaccaacccccucaacaccacccgcgaaaucgccaagcagaucgccgauuccaagccucuccucgccuucacgaucucugauuuacuccccaaaaucaccgcagcugcacccucucuaccaaucguucucauggacaacgacggcgccaauaauaacaauaacaauaauaauaucguggccacucuugaugagauggcgaagaaggaaccgguggcucagcgcgugaaagagcgcguggagcaggacgacacggccacgcugcucuacuccuccggcaccacggggcccagcaagggcgugguaucgucccaccgcaaccucauagcaaugguccagaucgugcugggucgguuccacauggaggagaacgaaaccuucauaugcacgguccccauguuucacauauacggccuggucgccuucgccacggggcuucuggcuuccggcuccaccaucgucgugcucuccaaguucgagaugcacgacaugcucuccucgaucgagagguuccgcgccacuuaccuccc

SEQ ID NO: 8616 - RNA, 97 nt, Glycine max
gagguugaaccacgugugcuucagccgcgacggagagugguugcuguucacggcgaacuuggguggcgugagugcggagccgguggggcugccgaac

SEQ ID NO: 8617 - RNA, 159 nt, Glycine max
ggaaauccagagagacaaaaauggccggugacggugcagcuacaugcauagacauccuccuugccaucauucucccuccucuuggagucuuucucaaauauggcugccagguggacaauaaacaaaugucaugggcguuucugucuuucaacucagaua

SEQ ID NO: 8618 - RNA, 113 nt, Glycine max
agguuguccggguguuggaugucccgguuccuguaucaaagaaggcgguuaggcaaauccggccgcgucauucaaggguaugggacgaguggcauccaacucucuaaacaaca

SEQ ID NO: 8619 - RNA, 60 nt, Glycine max
aauguacccgaaguaauaccuaauauggaugacuuauuagguguugauuuacgucaccaa

SEQ ID NO: 8620 - RNA, 110 nt, Glycine max
  misc_feature (96)..(96): n is a, c, g, or u
cugcaucuuuuuaaucaaggaaaucacgguugagugugaaggagagaaaguggcuucagauuuccggguuuuccuucuccacuguguuuccuuggnuuaaagauaugugc

SEQ ID NO: 8621 - RNA, 69 nt, Glycine max
uaucugccaagacagggcaaaagaggugguaauuacaaaaugcuaccacuuguucugcuacucauguau

SEQ ID NO: 8622 - RNA, 122 nt, Glycine max; identical to SEQ ID NO: 8607

SEQ ID NO: 8623 - RNA, 108 nt, Glycine max
cgggaaccacuguugcagcaacugguguuaaugauguauucugggagcaguucuugacugaggauccuggugcaucagaaacacaggaagugcagucagaaagaaagg

SEQ ID NO: 8624 - RNA, 163 nt, Glycine max
uucuucgaucaccucaugugucgaugagccaggcgugaccaccccuagacucagauggcgcuccaaccucucaguaaugucaucacaaacuuucacugcaugucuaggcuccuccacagauguggacgaugcuccuggcuucggcaugugagggauauccguc

SEQ ID NO: 8625 - RNA, 91 nt, Glycine max
uuguugugggguacugaggcuugguggaggcgggcgcggucgcggcggugaacguucauguggccgccgagggcuugugcugaacggaacu

SEQ ID NO: 8626 - RNA, 205 nt, Glycine max
uuggcugcagugcucugcaugguuguggugagugcacccauggcacaugcagcuaucacauacagacaaguaacaaauaaccuaaucaauuacaucaauuaccuccagaacaaaagaacaccaccaucaaaauacuacaacgaaguaaaaagccucaauaccaccaccaagaccaccaccaaccaccagacagcauacaacugcc

SEQ ID NO: 8627 - RNA, 119 nt, Glycine max
uaguaagagagauccuuagguuugcagguucauuuauguacaagggauuaaaguguaugccaaaguguuguccuaauuagcauguaaagaaccugugaauuugugaggagaacuaauga

SEQ ID NO: 8628 - RNA, 79 nt, Glycine max
aaagugaaagccaauuugcagagcaagggcgucgauuaaaaauggcgcaucuugccuugaagguuggcgaaaacaauga

SEQ ID NO: 8629 - RNA, 75 nt, Glycine max
aagugaaagccaauuugcagagcaagggcgucgauuaaaaauggcgcaucuugccuugaagguuggcgaaaacaa

SEQ ID NO: 8630 - RNA, 60 nt, Glycine max
ccggaggauacguugcccggucagcuucucccucccuugaggcugaccgggcgaaguuag

SEQ ID NO: 8631 - RNA, 110 nt, Glycine max
  misc_feature (27)..(27): n is a, c, g, or u
  misc_feature (37)..(37): n is a, c, g, or u
  misc_feature (55)..(55): n is a, c, g, or u
  misc_feature (76)..(76): n is a, c, g, or u
ucaaacugcucugaagcagcucaaugnguugguccgncagaccgguggcgccggnaaaggucgcaccaacaugcgncguaccgucaagagugcuccucagagcauuggua

SEQ ID NO: 8632 - RNA, 106 nt, Glycine max
uguguguagcuaagcucuagcuucucaaggaaguuuucucaaagaaucuucucaaggaaguuuucucaagaaaacuucucaaggaagcuaccuagucuauaaauag

SEQ ID NO: 8633 - RNA, 72 nt, Glycine max
gaaggcuuauggccuagggcagugaccuccauugcacuuugaaggggugcugcucuaaggucugcccaagug

SEQ ID NO: 8634 - RNA, 105 nt, Glycine max
ggucacuaugauguuggcucgacucacucagaccacgccggccggccggccggagccauccgcggcggugguucugauugagccgugccaauaucuuagugcucu

SEQ ID NO: 8635 - RNA, 136 nt, Glycine max
agucggacugguccaaccgggauuugguaccuaaccggccggguuugaccgggucaucucagguccauugcaugaccgauccaauaguggaaccaguccgguuaggccacuaggucccaguuagaccaguccgacc

SEQ ID NO: 8636 - RNA, 77 nt, Glycine max
acagaggaauccauucagaucuguuucgcaacaccauauuggguucgacugaaacagaucuaaauggauuccuuagu

SEQ ID NO: 8637 - RNA, 94 nt, Glycine max
auugcuauccaacugcuauucccauuucuaaaccuuguuacacgagcaucuugaucaauggucuagaaagggaaauagcaguugaguggugcuu

SEQ ID NO: 8638 - RNA, 94 nt, Glycine max; identical to SEQ ID NO: 8637

SEQ ID NO: 8639 - RNA, 105 nt, Glycine max
aagugcaagaugagauauugacgcggcucaauuaaaauuacauggcugguuuucaucuuaaccaugucuucaaauugaggcacgccaauaccuugauuugugcuu

SEQ ID NO: 8640 - RNA, 260 nt, Glycine max
ggaaauccagagagacaaaaauggccggugacggugcagcuacaugcauagacauccuccuugccaucauucucccuccucuuggagucuuucucaaauauggcugccagguggaguucuggauuuguuuggugcugacccuuuuugguuauauaccuggaauuaucuaugcugucuaugcuaucaccaagugaucacccuuuaacuuuguguggacaauaaacaaaugucaugggcguuucugucuuucaacucagaua

SEQ ID NO: 8641 - RNA, 103 nt, Glycine max
gugaagucacuggaugcagcgguucaucgaucucuuccugaaucguuguuuaacaucagaaccaugaaucgaucgauaaaccucugcauccagcgcucacuca

SEQ ID NO: 8642 - RNA, 128 nt, Glycine max
ccauuccuuacaauacugacgacaaaucgaggcauuugucugagaggauuccacucuuucucccguccuuuauauuuggguuguuuaauuuuuugcgcaugguuuguuguuucgauuguuuguauuuu

SEQ ID NO: 8643 - RNA, 83 nt, Glycine max
ccugaaaaugucuugcugcggugguaacugugguugcggaagcuccugcaagugcggcaacggcugcggaggcugcaagaugu

SEQ ID NO: 8644 - RNA, 84 nt, Glycine max
cauuauuucuugcuccugggccucgucguugggccugaguagcaaugcgacgaccaucuacgagguccugagcgagcacgggcu

SEQ ID NO: 8645 - RNA, 123 nt, Glycine max
acuuaugcuacaagaaccauauuuuucuugaaagaugauggaacuuugacaccauuggccauugaguuaaguaagccacauccucagggugaagaauaugguccuguuagcgaagucuacgug

SEQ ID NO: 8646 - RNA, 369 nt, Glycine max
aggcaacgacgguuggcauggagccgaaggagagagagaauaagaggccaagaucuuggauaguaauuaaccucacucaaacucgggaucacagaaaccaacaacagcucuugcacugagguuucacgauguugcuggaacuugcacuugguuuguguguguuagcuugguuucugcacuugcgucccacaccaagugcaaaaucaaaagcacuucgccaccucccaaacccuccaagcccaaagccucguccucccuucauugggcaccuucaccucuuaaaagauaaacuucuccacuaugcacucaucgaucucuccaaaaagcauggccccuuauucucucucuccuucgguaccauggcaaccg

SEQ ID NO: 8647 - RNA, 238 nt, Glycine max
aagaggucauaguucaucgacaagcuuuagaagugcuagauagaggguacuccuacuagcaucgaccgccuauauaccaaacucauccaaauugaggucaaaaguuucaaaggguaauagguugucaaacuuugacauuuuugaccucaauccaaaugagucugguaggcgaccgaggcuaguaggaguguccuuuguugggcacuuucgaggcuugucgauggacuacagcuuuuuu

SEQ ID NO: 8648 - RNA, 159 nt, Glycine max
auagaggguacuccuacuagcaucgaccgccuauauaccaaacucauccaaauugaggucaaaaguuucaaaggguaauagguugucaaacuuugacauuuuugaccucaauccaaaugagucugguaggcgaccgaggcuaguaggaguguccuuugu

SEQ ID NO: 8649 - RNA, 182 nt, Glycine max
acccaacuuggaguucccugcacuccaagucugaaaggauaugaugguaaaccucuacugcuaguucauggauaccucugacuucuuaacaacaugcguucgaagucaaggguuugcaugcccugggagaugaguuuaccuugaucuuuugguauuggagugaagggagcuccagaggguau

SEQ ID NO: 8650 - RNA, 187 nt, Glycine max
aaaaaaagaccccuuuauuuuaagggggguugguuagacacaaaacaccggagggcaacauaauacauacuacauaauuuggagguuuugaaacuacauaaaguggguauuauuauugcuaagggccauuuuugcuugaagcguuagcucuccaacaccucacuugcaagugcagggguugcagggg

SEQ ID NO: 8651 - RNA, 77 nt, Glycine max
ugcguuccccgguccuuucgguuccggauuccucagcccccagccccccggggucgacgggaucgggucuguaacga

SEQ ID NO: 8652 - RNA, 138 nt, Glycine max
uggaggagcuaccuccugagccugcuguggaugcccuugacuuucuagagggugaugaggauccacuucuugagguggauucucccgaggaagucaugucggcaucugaggcagacucuacggaggauaguggcccgg

SEQ ID NO: 8653 - RNA, 100 nt, Glycine max
aaggacccauuaugggauaaaugugagcucaggagcgaugaauaaauccuuucaugacuccucauuacucccgagcucacauuuauuucaaaaugagucu

SEQ ID NO: 8654 - RNA, 108 nt, Glycine max
ggucucuaauucgcuuggugcaggucgggaaccgguuuucgcgcggaauggaggaacggucgccggcggcgaauuggaucccgccuugcaucaacugaaucggaggcc

SEQ ID NO: 8655 - RNA, 182 nt, Glycine max
acccaaguuggagcucucuacacuccaagucugaaggaagugacgguagacccuugcugcuaauucaugguuaccuuuggauucagauaaggaagcaugugaaagucaugggucugcaugaauuugaagacggggcuaccuugaucuuuuaguauuggagugaagggagcuccgaauuaggc

SEQ ID NO: 8656 - RNA, 385 nt, Glycine max
gcuuccacuuuugcuaauugcauggcuuccaagaccacaauucauugcugcuuccgcggugaagacacacgcaauagcuucacugguuuucuuuuucaagcucuuaguagaaaaggcaccauugaugcauucaaagaugguaaagaucucaagaaaggcgaauccauagcgccagagcugauccaagccauucaagggucucgccuuuucuucauugugguguuuucaaacaacuaugcuuucucaacuauccgaaaaaagcagguauauuguucgagaaaaaucaccuaagaagccaagaaaauggaguagauuaugggauuucaaaaagaucuccacaaaggcagcagauuaucuugaagccaugguuauuaaaaauaaagca

SEQ ID NO: 8657 - RNA, 109 nt, Glycine max
gucuucauuuugccggaaagcaacuugaggacggccguacucuccuucugaauguuguagucagcaaggguacggccguccucaaguugcuuuccggcgaaaaugagac

SEQ ID NO: 8658 - RNA, 130 nt, Glycine max
cacaaagacuuaugcuacaagaaccauauuuuucuugaaaaaugauggaacuuugacgccauuggccauugaguuaaguaagccgcauccucagggugaagaauaugguccuguuagcgaagucuacgug

SEQ ID NO: 8659 - RNA, 91 nt, Glycine max
gcuucaccaaguuuagucguucugauuaucucaaguucaagucagagaauagaauugugcccgauggugugaaugcuaagcuucuugguug

SEQ ID NO: 8660 - RNA, 133 nt, Glycine max
acaggacaaagcaggggaacaggccagagcauggauggagcuaucaacacaauauugucaagaaacugagagugagaggagaaauauguugugguucugcucaugcacugccucuucccuggcucugucucca

SEQ ID NO: 8661 - RNA, 123 nt, Glycine max; identical to SEQ ID NO: 8645

SEQ ID NO: 8662 - RNA, 106 nt, Glycine max
uugguauugaggggaauguuggcuggcucgaggcuuuucacaaaggagguucacaguggauggaacuauaaggcuucggaccaggcuucauuccccucaaaaguac

SEQ ID NO: 8663 - RNA, 107 nt, Glycine max
cucugguaagcaaccaaguuuugagcagccagaaacauucagaacuaugagggaguuuaaguuaugaaagguaucuggaaggcaaacaagauuuuugcgauucuuca

SEQ ID NO: 8664 - RNA, 69 nt, Glycine max; identical to SEQ ID NO: 8568

SEQ ID NO: 8665 - RNA, 62 nt, Glycine max
uacaucucuuguggaucaguucaaguggagcauacauccacuuggugguucaaagagaacaa

SEQ ID NO: 8666 - RNA, 134 nt, Glycine max
cugguugcacgcacagcacagccacagcagcaaccugguacaaguguuugggauccauuguauucuuaaucacuggauccacaauguuuggaagcuuggaucuguccgugagcuguggcauggcccaugugaca

SEQ ID NO: 8667 - RNA, 85 nt, Glycine max
gugucgguaccggugcucccguauacuuggcugcaguucucgaauaccuagcugccgaggugcuugaguuggcugggaaugccgc

SEQ ID NO: 8668 - RNA, 214 nt, Glycine max
cugauguuguaagugacauuuaacaucgguuuuuuaaaaaacugauguuguaagugacauuuaacaucgguuuuuuaaauaaccgauguuguaagugacauuuaauguuguaaguaacauuuaacaucgguuuuuuaaaaaacugauguuguaagugacauuuaacaucgguuuuuuaaauaaccaauguuaaaugugacaugugacaucgguu

SEQ ID NO: 8669 - RNA, 70 nt, Glycine max
auuauccaccgucuucaucagauucuugagccuuucaugcucaggcgucguguugaagauguugaggguu

SEQ ID NO: 8670 - RNA, 129 nt, Glycine max
auauauauauaaucgaaagaguuuaauagucaugcaccuuagaauaaaaguauuuucuuuauaaacuaauuagaaaacauccuuauuccuuaguaugcaguacuaugacuuuggugguuauuauaaaag

SEQ ID NO: 8671 - RNA, 159 nt, Glycine max
uggccccggaucucuaccggcugcuauugaucaacacgccuacugccaaaggagagagcaaaauucagagugaagacaagcaacgugaugcagagggagaagaugguaacgaugaugaaggcgacgaugacgacgauggagaugguggauuuggggagg

SEQ ID NO: 8672 - RNA, 260 nt, Glycine max
guaagcagcaaauagcauuugguauuauuuuuugugcacccuuuuugauaugggguuuuguuauggauuuaaguguuuucaauaucacucaaauuuucuauaugugacuuguuuuuuugggauacucuaaggucuaaacaagaguguaugucuaauaauaaagugauuuuugaagauuaucaauuuucuguaauagagguuauuaguaaaauuaaguuucuuauguauagacaagcguaccuguugcauuuguuuuagcu

SEQ ID NO: 8673 - RNA, 87 nt, Glycine max
cuccuccucuucgccgccguguccagcgccgccgacgacauccugauccgucagguggugccggaugccgucggcgaagcggcggag

SEQ ID NO: 8674 - RNA, 111 nt, Glycine max
acaaaauugggggaaggcauggguauggggggauugggaaggaauauccauaagcaaaauaugcuauuucuuuccuacaccucccauaccacuguuuuuccucucuuucuc

SEQ ID NO: 8675 - RNA, 130 nt, Glycine max
cuuugaucugggugagagaaacgcguaucgauggauuggguucaguacuggucucacacgguuuguucuaacaauuuguacugacuguguauugaucgauacgggucgcucucaccuaggccagaguugc

SEQ ID NO: 8676 - RNA, 375 nt, Glycine max
uuugagagguugaagcugccagcaugaucugguaaaucacauacuuuuuuuuuucucaccucucaugccuaauuuuuaagcaccagucauuagagaaaauaauggugaaaaauccaucuauucaauuuuuuuuuucaaauucaagguuuccaguauguaucacuaauggugaaaaaagugauggaauuuuguagaacauggguuaaauuuacuuuuuuuuuuuuugaguuuucauuuucuucaaguuucugagccaagaaauaaaagagacuuauaaauuggaauuaauacuuaaaggaaacccaccagaagggcaauuugguuaucauaagaugugguuuccaucaggucaucuugcagcuucaaucacucaau

SEQ ID NO: 8677 - RNA, 206 nt, Glycine max
ggauuaagugauuuacacuuagauuuuuguguuuuuuuuucuaaucaauauuuuggaagaaaauuuagaucuaaagguucagcacaagaauauuaugaaugaaaauugauagaaccuaaaaucaacacaaaaacaagauucaagaguagaucuacaaaauuugaaccauagaaaugcaagaacaaguguagaucuaagauuuaauc

SEQ ID NO: 8678 - RNA, 67 nt, Glycine max
ggaaacacugucaauaggaagcaguugugauucacucacaucucuuccauugguuaccuuuccaaau

SEQ ID NO: 8679 - RNA, 182 nt, Glycine max
auuugcugcuggaugaugugggcgauuguauaucuggcacagaugaaaccacucauugugccuauacugaacgagggugaauaagucucugaacagauguaacuccuuuauuuuuucaggguggaacuguauuuauuucuuguuggauaauggcauuccaguuggcauuucuauugcuacgu

SEQ ID NO: 8680 - RNA, 77 nt, Glycine max
uugccuucaaucgccguggcacccuucuugcugcuggaugcaacaauggaaguuguguuauuugggauuuugaaacc

SEQ ID NO: 8681 - RNA, 105 nt, Glycine max
uucaugauaguggguuagcucaaagaucucacaugauccagguggaauugaucagguggaauccuuggaucaugugauauccuugagcuaauacacuaucaugaa

SEQ ID NO: 8682 - RNA, 209 nt, Glycine max
gagcagagguaguggagugcggaugcguaauugaauugccagaauuaaaaguguucauucaguuauuucuuugauucuugcuuucauuuuggaccgugcugcucaucaucacaggaucuuucaggaauaauuuggagacguauuuuaaugaaguuagaucauuggaagcaguuagauucaaggcgcuuugcauccagugggcacaguau

SEQ ID NO: 8683 - RNA, 99 nt, Glycine max
cugcuaacggugagaacauggggagccucuauucuuuauuagcaucagaaggggagcccgccagaaaauagaaguuacccaugcucucaaaguuaggag

SEQ ID NO: 8684 - RNA, 406 nt, Glycine max
ccccggcaucauaaaguuucuuacauaaucaauuaaaaaucaguacucuaaauauauuugaaaaucaguccaggcuaauuuauuuaaacuuauaugugaaaaaagugauaaucaauuaaaaaucagucuaaacauauuuguuuaaacuuccaaucaaucaauacuaugguaaaagugagcacuuuuaucauacauguguuuauucaugauugaauaacuacacuucuaauuaaauuuguauuuuauuuucucgaucgacuaauuacccuagaacaucaguuaacauuuucuguuguccuuucuguguuguuauugcaggaguuugauaggaugcauggaccugguuggcaguguauuguaggcacugauuuugguucguuugugacucacuguuguggcuguuuca

SEQ ID NO: 8685 - RNA, 112 nt, Glycine max
uuguuggacugcacggggcuucuccaucucacaucccugcaaauauuauacauaggcaauuguccuuugcuggagaauauggcuggagaaaggcuuccugucucucuaauaa

SEQ ID NO: 8686 - RNA, 78 nt, Glycine max
gaugauuguguuaagcuaugagaucugagggcuucaaauuccuuuucuccuuccggauuucauccuugugucucuuua

SEQ ID NO: 8687 - RNA, 77 nt, Glycine max
augauuguguuaagcuaugagaucugagggcuucaaauuccuuuucuccuuccggauuucauccuugugucucuuua

SEQ ID NO: 8688 - RNA, 73 nt, Glycine max
gauuguguuaagcuaugagaucugagggcuucaaauuccuuuucuccuuccggauuucauccuugugucucuu

SEQ ID NO: 8689 - RNA, 127 nt, Glycine max
cagaacuuggacggccguaacaucacugucaaugaagcucagucccgcgguggcggcggcggcggcggcggaggaggaggaggauacaaucgugguggcgguggauaugguggucguaguggcggug

SEQ ID NO: 8690 - RNA, 109 nt, Glycine max
cugauccccuccgacgccgucuacgaccuccgcugcaucgccgagcgcaugcucuccuccggcuaccuccgcgagugcauccaggucuacggcagcguucgaaaauccu

SEQ ID NO: 8691 - RNA, 88 nt, Glycine max
gauugugguuucaugaggauucacuuaauguauugacaaagaauacugggacaaaagcuauugagggauuggcucugaaauugcauuc

SEQ ID NO: 8692 - RNA, 194 nt, Glycine max
guagauuuuucggugaaguugguaagguauaugcugucagguggaaugacguacuggacgguguguggcauuugguugacaaagacgaaaauuaucauaacguuguguauaacaaagauuuagaccaaccagccauuguagcaggguggacaacauuacgagauuuuuaccagcugaccggagaucaucuagua

SEQ ID NO: 8693 - RNA, 90 nt, Glycine max
guugaauuccagagggaacuguuuugaguugggagaggucuucuaaaccaauuucuuccacagaacacagugcuccucugucgauaagga

SEQ ID NO: 8694 - RNA, 78 nt, Glycine max
aacggcugccuccaacgcaucaucgaaaucgucgcuaaaauucgacgacuucgaggacacguuggagauguagccaaa

SEQ ID NO: 8695 - RNA, 106 nt, Glycine max
uugguauugaggggaauguuggcuggcucgaggcuggucacaaaggagguucagaguggauggaacuauaaggcuucggaccaggcuucauuccccucaaaaguac

SEQ ID NO: 8696 - RNA, 107 nt, Glycine max
gauacguucgucagacgauguauggaaugagagagggaagagaguaacgacagaaucggaaaauacccuuucccuucucucacuccauacaccucugccaaacacug

SEQ ID NO: 8697 - RNA, 78 nt, Glycine max
cuuucaacccauugaacaucucugauuacaacuccaucuuuuggauugcacuagagaugugcuuagugaauaugggaa

SEQ ID NO: 8698 - RNA, 112 nt, Glycine max
agcaaaaucucuugcuugugcuguauuuggugaagcucagccuuucaaagaguuggucaacuuuucacccagagaaggggcaauucuugcgaaugcaacaccuguaggaaug

SEQ ID NO: 8699 - RNA, 94 nt, Glycine max; identical to SEQ ID NO: 8637

SEQ ID NO: 8700 - RNA, 72 nt, Glycine max
augggaagcugugcaggauucucuuguuuguggagcucagggaaguaggauccuugucacaacacgcaguga

SEQ ID NO: 8701 - RNA, 75 nt, Glycine max
acuuuucacucggauguccgauuuaggcgcauaauauaucgagacgcucgaaauugggcaacuggagcucacgag

SEQ ID NO: 8702 - RNA, 100 nt, Glycine max
uucagaagcucguggagcggcaugggcccagaaacuggucccucaucagcagguccauuccgggccggucugggaaaucgugcaggcuccgauggugcaa

SEQ ID NO: 8703 - RNA, 150 nt, Glycine max
augugaaauuucacuggaagaccacuagugguauaaagugucuauuggaggaagaggccauuaaggugggaggagccaaccacagccaugccacucaagaccuccaugauucaauugcugcugguaacuauccugaguggaaacuguuug

SEQ ID NO: 8704 - RNA, 72 nt, Glycine max
uaaccgauaaaagcaaagaggaccguuuaaggcgcuggaccuuaaaacgguuuuuagugauuuuucgaaaaa

SEQ ID NO: 8705 - RNA, 182 nt, Glycine max
auccagagaagcaaugcggcacaaugaccaauugaagagaagcgaucgaauucaggaugaaaguccacaucauaaggggcgagaugaugcuucugcccguggaaaucaauauacuacugaggaaaggcgaucuaggcuagaaaggucaaguagucguagugaucguguugcuaauguuucug

SEQ ID NO: 8706 - RNA, 112 nt, Glycine max
cacccucaucuccgaucucccucuucgugucgcucaugugcguugcuuucgcgugcgccacaucguugaacaaaauugagcacugcgaguuggauugugcaaguuccacggu

SEQ ID NO: 8707 - RNA, 196 nt, Glycine max
gcuuagaucugaccaggguucugggcuguuaaguaauagggagggagaccccuucuuuccuaugacaggguucccuaacucgacaauggaacacaugacaggguucccuaacucgacagugggacacauggauaaaucauuguugaguuaugauacuuuuccugcuggcaugcagggagccaggcaugaucuauuu

SEQ ID NO: 8708 - RNA, 197 nt, Glycine max
gcuuaaaaguggguuggagaguaguagugucaaaauaaugggcaacaccucuggcaggguaguaucuaauggaucucaaguacauauuggccauuaaagugccaaauagaucaucauuccuauucugagugaggacuggauaauggguaugauaaaggcuuuaguaaugacaaucuauuuuccuuccaaauguaauu

SEQ ID NO: 8709 - RNA, 178 nt, Glycine max
aaaagagaaguaauaguggaugugacgugcauaguguuguuauuguaaaguuaauuaacuagugugauuuccaagguaaacacugcaaguuauugcaagauucuguccauguacuagugcaggcaccuccaaccccaucacaacacuugcauacaaguccaagcguugcaaaaaucuu

SEQ ID NO: 8710 - RNA, 106 nt, Glycine max
gagguguugaggggaauguuggcuggcucgaggcuuuucacaaaggagguucacaguggauggaacuauaaggcuucggaccaggcuucauuccccucaaaaguac

SEQ ID NO: 8711 - RNA, 91 nt, Glycine max
cagaggcaaaucgcagguucgugcgugaaucuaaucaaaguuucucauuaacuucugcguuagauucacgcacaaacuugucauuucccuu

SEQ ID NO: 8712 - RNA, 88 nt, Glycine max
aggcaaaucgcagguucgugcgugaaucuaaucaaaguuucucauuaacuucugcguuagauucacgcacaaacuugucauuucccuu

SEQ ID NO: 8713 - RNA, 122 nt, Glycine max
uuucgugaucuuccacagcuuucuugaacuguguugugaggcuucucuccaaugaacguuuauacccuaugcaaaagaaauucuaugagcacaauucaagauagcuguggaaaaucacugag

SEQ ID NO: 8714 - RNA, 107 nt, Glycine max
gcuagguucgucagacgauguauggaaugagagagggaagagaguaacgaugggaucggaaaauaucauuucccuucucucacuccauacaucucugucaaacauug

SEQ ID NO: 8715 - RNA, 205 nt, Glycine max
gagaaggaggcaggaauugcaugugcuugguaaccaaaaccaaacaaagccuuaagaguucauuuuugggaugaugcguuuucucggagacagcaucaaaauccaaaacuguuauuuuuuuuucgugaucucuuacuuuucugaacgccacacagauccaauggcagagcugcuacuaaucacaugcaucucacuacuuuuccuc

SEQ ID NO: 8716 - RNA, 144 nt, Glycine max
uggguggagaguuccaaagggaucgcauugaucuaauucuuguagauguuuacacuugcaagcuuugcaugcaauuccuggauucagaugugauucagugguucacuuauuggaucaugcgaucccuuaggaacuuuccaucaa

SEQ ID NO: 8717 - RNA, 142 nt, Glycine max
ggguggagaguuccaaagggaucgcauugaucuaauucuuguagauguuuacacuugcaagcuuugcaugcaauuccuggauucagaugugauucagugguucacuuauuggaucaugcgaucccuuaggaacuuuccauca

SEQ ID NO: 8718 - RNA, 729 nt, Glycine max
uccgcuagacccucccgcaugcgacuauuccucuuucccuccgauacucuuccuuccccuccaccugcugcuucugcuccacacgauucgguuaucaaaccuaauaacgucgauuuucucuucggucuccagccucagccaccaccuauugaugucaaauucaaugauccgcugccggagcccguggcgccgccgccggagcauccguugcgauucaauuuuaacccugcggucucggauccgagcgcgauucagcgccaguugcagcaacugcaaauugcggagaacgagcaagcugcgcaucggaggaagggugaggauaauuaccccgccggugauuacuacguucaaaaagugccugagaaguuccccccaccgaauuuucuggcaagcucgccggguuauuggccugaaaaacauguuuccggcgacguuuauccuccggcugugacggcuacguccggcggaggggaaccgucgguuuauaugguuccggcgccggggacguucuaucaugcaccgguuaugcggccuccaccuccagcaacucagggauacuacaccgugcaacgaauggguuccgauaauuaccgugaagcgccgguguacggcgguguuccgccgccaaaagcggcgguuccggcgaguauggcgccagcccagcagccgauuaaggcucccgcguauacggaaggauucggaaugguucggccaggugggauaguggau

SEQ ID NO: 8719 - RNA, 271 nt, Glycine max
gugaacuccgauauuuuccugcacugacuuagugauucguuucauauuucucagcuucgauuauccguuugucgauggcggacucggacaacgacuccggcggcgcgcacaacgccgggaaggggagcgagaugucgccgcgggagcaggaccgguuccugccgaucgcgaacgugagccgcaucaugaagaaggcgcugccggcgaacgcgaagaucucgaaggacgcgaaggagacggugcaggagugcgugucggaguucaucagcuu

SEQ ID NO: 8720 - RNA, 202 nt, Glycine max
uauggcaggaugggacucucugaucuuggauccugaaucagcuacaauagagaggaaucgaucacucaccaaagaagaaauuaaugcuuacuggagaguaaagaaggagacagaguuagaacaccucagagcuauguccaaacuaucugagacuauucaggcccgaaaauuugaggauucagagaauucucauaagucaagu

SEQ ID NO: 8721 - RNA, 109 nt, Glycine max; identical to SEQ ID NO: 8593

SEQ ID NO: 8722 - RNA, 94 nt, Glycine max
ucaugaaggugcugguggagcugauggcggacuucgagucgaacaugguggacaagucggcguacguggugagcgugcugguggcgguagcgga

SEQ ID NO: 8723 - RNA, 91 nt, Glycine max
guguccgacauguguccgugucaguguccgacaccgacacgcguccgugucagugucggugucggugcuucauagguuacaugagccuaca

SEQ ID NO: 8724 - RNA, 128 nt, Glycine max
uaccugucauugcuguugguguugggcucaguacauaugauaaagcaucugacaaauacuauauacaaucacacauccaacugaaugaauauagggaucgagugaucuugccaacagcuacaaggaaa

SEQ ID NO: 8725 - RNA, 172 nt, Glycine max
aacaauugaugggcaucuacaacuugcagcagucaucccagcaggcugaagaugcucuuucccaagggauggaugcauugcagcaaucacugucugagacauuggcuaaugguucacccagcacaucaggcuccucgggaaauguggcaaguuacauggggcaaauggcuau

SEQ ID NO: 8726 - RNA, 95 nt, Glycine max
ucagaauuugugggaaugggcugauugggaagcaaugugugcuggugcaaugcauuuaauuucuucccaauuccgcccauuccuaugauuucuga

SEQ ID NO: 8727 - RNA, 79 nt, Glycine max
uagcacuuaagaguuucaaugcagagguaguugaugaagcagggaacccugugccucuucaugaaacuuaucuccacca

SEQ ID NO: 8728 - RNA, 109 nt, Glycine max; identical to SEQ ID NO: 8593

SEQ ID NO: 8729 - RNA, 94 nt, Glycine max
gaccuuccuaccgauuucgauuggcgcgaccauggagcuguuaccggcgucaagaaucaggggcucgugcggaucguguuggucauuuagcgcc

SEQ ID NO: 8730 - RNA, 84 nt, Glycine max
cugcagcaguugaagcugccagcaugaucugaguuuaccuucuauugguaagaacagaucauguggcugcuucaccuguugaau

SEQ ID NO: 8731 - RNA, 114 nt, Glycine max
uucucuuuuccguguuuaauucaucaauguuauuugucauguauucaauugaauccgugcacaauaagccgaugcucuggauaacauaaugaaggcagcaugguugugugcucg

SEQ ID NO: 8732 - RNA, 84 nt, Glycine max
cucuuccuuauguggcucguuuucaugcaaagaggguauugaaauuucaagaugcacuguugacaagcuaucaucgaaaugaga

SEQ ID NO: 8733 - RNA, 126 nt, Glycine max
aaaauucaagaagcaaaggacuccauugaugaagaagauccaaggccuacaugcuccaauggagcuacaucaugugguaucaagagcaucuucauauaggugauguucuuuugcuuccucaaucuu

SEQ ID NO: 8734 - RNA, 126 nt, Glycine max
agaacuuggacggccguaauaucacugucaaugaagcucagucccgcgguggcggcggcggcggcggcggaggaggaggaggauacaaucgugguggcgguggauaugguggucguagugguggug

SEQ ID NO: 8735 - RNA, 188 nt, Glycine max
  misc_feature (44)..(44): n is a, c, g, or u
  misc_feature (49)..(49): n is a, c, g, or u
uccuaacuuugagagcauggguaacuucuauuuuuuaucucugnccccnuuuccuucaucuuuucuucaaccuuuauucguuccuuuuucaacuguuaaaaggccugacuauguugaggaaauuaagaaaauggguuuguugccgaugccagcagaauagaagcuccccauguucucaccguuagcag

SEQ ID NO: 8736 - RNA, 92 nt, Glycine max
gcgcggccuuacuucaaagcgccuccggcggucauuccgaucuaugauuggagcggcuucuacgucggcagugcugggacguggucaacgcc

SEQ ID NO: 8737 - RNA, 218 nt, Glycine max
uugggaauuugguucuguuuuuuuuuuuuuugguggugagucaccaauggaagguggaaugauuuuugcgugaaaaaaugcuucucacuauuucucaaaguagcuuucaaagguucgccauauuuuuauuauuaaaauaaaaaaagaauucccuuucuuuuucuucuaauuuuaaagauuuaacugccgaggaaaacgaggaaggaccagauacgaga

SEQ ID NO: 8738 - RNA, 85 nt, Glycine max
acagaguuucuuggcauucuguccaccuccacuucuuggcccuaucuacguacucggagguggauauacugccaauagagcugug

SEQ ID NO: 8739 - RNA, 144 nt, Glycine max
auaguuucuuacggauuguuagugcuguggaguuacguuguuaucacugucuuuuacugugacuguagaaaacgccauccaauuagggaaccccaaccagaugaugaugaccacccacaacaacaacucucuguaauauaauau

SEQ ID NO: 8740 - RNA, 100 nt, Glycine max
gaagaaucuguaaagcucaggagggauagcgccauggaugaucuucucuucacucuugaucuucucuugcgcuauccauccugaguuucauggcuucuau

SEQ ID NO: 8741 - RNA, 96 nt, Glycine max
gaaucuguaaagcucaggagggauagcgccauggaugaucuucucuucacucuugaucuucucuugcgcuauccauccugaguuucauggcuucua

SEQ ID NO: 8742 - RNA, 21 nt, Glycine max
uuagaugaccaucagcaaaca

SEQ ID NO: 8743 - RNA, 106 nt, Arabidopsis thaliana
ugcaacccuugaauguguuuguugauugauaucuacacauguugaucauccuuguguugaucgauugguuuagaugaccaucaacaaacucuuucgugguuuugca

SEQ ID NO: 8744 - RNA, 21 nt, Arabidopsis thaliana
uuagaugaccaucaacaaacu

SEQ ID NO: 8745 - DNA, 2798 bp, Arabidopsis thaliana
ttaattttcatacatacgtttcattttcatacacaattaagccaacacgagacgcaagagagagatagggaaagagattagagcgactctgttttgttgatcaaaatcctttttttttgtttgagggctgaatttgtttgttgatggtcatctaaatttgtaagcttttatctgttttatggagttgtgaaattcagataaaaaataaatgaagttttgtaagaagtatgaagagtacatgcaaggacagaaggagaagaagaatcttcctgatgttgggtttaagaaactcaagaagattctcaagagatgcaggagaaatcatgttccttctagaatttcttttactgatgcaatcaaccataattgttctcatgaattcccagttagtgatgggacttttttcccggaacttcacaaggaaatggaagatgttgttggatggtttaacgagcatgctcagaagcttcttgagcttcatttagcttctggttttacaaagtgtcttacttggctcagaggcaacagtcgaaaaaaggaccatcatggtttgatccaagagggtaaagatttggttaattacgctctcatcaatgccgtcgccattcgaaaaatcctcaagaaatatgacaagattcatgagtctaggcaaggacaagcgtttaagactcaggtccagaaaatgcgaatagaaatccttcagtcaccgtggctctgcgagcttatggcgtttcacatcaatctgaaagaatctaagaaggaatctggagctactataacttctcctcctcctcctgttcatgcattgtttgatggttgcgctttgactttcgacgatgggaagcctttactttcctgcgagctctctgattccgtcaaagttgacattgacttgacttgttcaatatgcctggacacggtgtttgatccaatatctctaacctgcggtcacatatattgctacatgtgtgcttgctctgctgcatcagtaaacgtagttgatggcttgaaaaccgcagaagcaactgaaaaatgcccgctttgccgtgaggatggggtttataaaggtgctgttcacttggatgagctcaatattttacttaagcgaagctgcagagactattgggaagaaaggcgtaaaacagagagagcagaaaggttacaacaagcaaaggaatattgggattaccaatgccgaagcttcactggaatatgatatagtttgatttgtggcttcttaagtgagattcttgattttgataataagatagtaaaaataatcttaattttgatttgctttcctctgtgagtgtgtttccttgcacagagagtgacgatttctttgtgaaaaaactgaaaactcttaagcattaaatatggtttataagtttgcagaaaacaaaaaaacttacaagggttctgctcattggtccattggtgttgcctctgatactattgctgagtttccgcacgagatcattgacttgtattccttcatatgtggctatactacagtgtactggatttattctgagcattctattctgggttattgcacccaggcatttaaatatgaataaatgatgtgaaaaatgaaacatttctctctacttttcatttttctggtcatccttttggcaacaagctacattgatgccttcaccagaaacgattttccagaggatttcctcttcggagccgccacttctgcttatcagtgggaaggagctgttgatgaagacggaagaactcctagcgtctgggatacaacctcccactgttataatggaagtaatggagatatagcatgtgatgggtatcacaaatacaaggaagatgttaagttgatggcagaaatgggcttagaatcattcagattctctatctcctggtcaagacttatacctaatggaagaggacgcattaacccaaaaggtttattgttttacaagaatctcatcaaagagctacgaagccatggaatcgaacctcacgttacactttaccactacgatcttcctcagtctcttgaagatgagtatggtggccatggcagatgtatgcttctggatatacaattttcgccattggttcttatggtcttgttctcctaacaaattgtggaaattcttctaatcttgcaggccataacatattgctagctcatgcctctgcttcaaagttgtataaacttaccgcagggatccatagggcttagtatatttgcatcggttatctccatatacaaactccacgatgaaacgctaaagctttcttctatggctggatgttgaagcctttggtatttggcggatgaaatgaaggaatgggatcggacattctatgtcacaaaccaaccccccttatatctttcccagcatgaacaaaggcttctttaaagacatgggcgcatatattatctccactgggaattcttcattatttgtgtttgatgctactccatggggtcttgaaggtgttcttgagtatataaagcagcgctataacaatcctccaatctatattcttgaaaatggttcaccgataacattcatgctaagacacagagttgaatacattcttactgctgttcaacgcacatctgattttcttggtagaccaaatggtacaattgatgttgcttctcaaaatattactaagttgcagaacaagttctctggctcttcttcattgtaatgttcttaaactaaagtagcctggtttgattttgatctatctattctatgataaagacctcagggatttgcatatgaataaatgatgtgtcttgtgagacc

SEQ ID NO: 8746 - DNA, 21 bp, Arabidopsis thaliana
tgtttgttgatggtcatctaa

SEQ ID NO: 8747 - protein, 335 aa, Arabidopsis thaliana
MKFCKKYEEYMQGQKEKKNLPGVGFKKLKKILKRCRRNHVPSRISFTDAINHNCSRECPVCDGTFFPELLKEMEDVVGWFNEHAQKLLELHLASGFTKCLTWLRGNSRKKDHHGLIQEGKDLVNYALINAVAIRKILKKYDKIHESRQGQAFKTQVQKMRIEILQSPWLCELMAFHINLKESKKESGATITSPPPPVHALFDGCALTFDDGKPLLSCELSDSVKVDIDLTCSICLDTVFDPISLTCGHIYCYMCACSAASVNVVDGLKTAEATEKCPLCREDGVYKGAVHLDELNILLKRSCRDYWEERRKTERAERLQQAKEYWDYQCRSFTGI

SEQ ID NO: 8748 - DNA, 1008 bp, Arabidopsis thaliana
atgaagttttgtaagaagtatgaagagtacatgcaaggacagaaggagaagaagaatcttcctgatgttgggtttaagaaactcaagaagattctcaagagatgcaggagaaatcatgttccttctagaatttcttttactgatgcaatcaaccataattgttctcatgaattcccagttagtgatgggacttttttcccggaacttcacaaggaaatggaagatgttgttggatggtttaacgagcatgctcagaagcttcttgagcttcatttagcttctggttttacaaagtgtcttacttggctcagaggcaacagtcgaaaaaaggaccatcatggtttgatccaagagggtaaagatttggttaattacgctctcatcaatgccgtcgccattcgaaaaatcctcaagaaatatgacaagattcatgagtctaggcaaggacaagcgtttaagactcaggtccagaaaatgcgaatagaaatccttcagtcaccgtggctctgcgagcttatggcgtttcacatcaatctgaaagaatctaagaaggaatctggagctactataacttctcctcctcctcctgttcatgcattgtttgatggttgcgctttgactttcgacgatgggaagcctttactttcctgcgagctctctgattccgtcaaagttgacattgacttgacttgttcaatatgcctggacacggtgtttgatccaatatctctaacctgcggtcacatatattgctacatgtgtgcttgctctgctgcatcagtaaacgtagttgatggcttgaaaaccgcagaagcaactgaaaaatgcccgctttgccgtgaggatggggtttataaaggtgctgttcacttggatgagctcaatattttacttaagcgaagctgcagagactattgggaagaaaggcgtaaaacagagagagcagaaaggttacaacaagcaaaggaatattgggattaccaatgccgaagcttcactggaatatga

SEQ ID NO: 8749 - DNA, 540 bp, Arabidopsis thaliana
atgaaaatgcgaatagaaatccttcagtcaccgtggctctgcgagcttatggcgtttcacatcaatctgaaagaatctaagaaggaatctggagctactataacttctcctcctcctcctgttcatgcattgtttgatggttgcgctttgactttcgacgatgggaagcctttactttcctgcgagctctctgattccgtcaaagttgacattgacttgacttgttcaatatgcctggacacggtgtttgatccaatatctctaacctgcggtcacatatattgctacatgtgtgcttgctctgctgcatcagtaaacgtagttgatggcttgaaaaccgcagaagcaactgaaaaatgcccgctttgccgtgaggatggggtttataaaggtgctgttcacttggatgagctcaatattttacttaagcgaagctgcagagactattgggaagaaaggcgtaaaacagagagagcagaaaggttacaacaagcaaaggaatattgggattaccaatgccgaagcttcactggaatatga

SEQ ID NO: 8750 - DNA, 864 bp, Arabidopsis thaliana
atgaagttttgtaagaagtatgaagagtacatgcaaggacagaaggagaagaagaatcttcctgatgttgggtttaagaaactcaagaagattctcaagagatgcaggagaaatcatgttccttctagaatttcttttactgatgcaatcaaccataattgttctcatgaattcccagttagtgatgggacttttttcccggaacttcacaaggaaatggaagatgttgttggatggtttaacgagcatgctcagaagcttcttgagcttcatttagcttctggttttacaaagtgtcttacttggctcagaggcaacagtcgaaaaaaggaccatcatggtttgatccaagagggtaaagatttggttaattacgctctcatcaatgccgtcgccattcgaaaaatcctcaagaaatatgacaagattcatgagtctaggcaaggacaagcgtttaagactcaggtccagaaaatgcgaatagaaatccttcagtcaccgtggctctgcgagcttatggcgtttcacatcaatctgaaagaatctaagaaggaatctggagctactataacttctcctcctcctcctgttcatgcattgtttgatggttgcgctttgactttcgacgatgggaagcctttactttcctgcgagctctctgattccgtcaaagttgacattgacttgacttgtcgtgaggatggggtttataaaggtgctgttcacttggatgagctcaatattttacttaagcgaagctgcagagactattgggaagaaaggcgtaaaacagagagagcagaaaggttacaacaagcaaaggaatattgggattaccaatgccgaagcttcactggaatatga

SEQ ID NO: 8751 - DNA, 4141 bp, Arabidopsis thaliana
aatttctctttgatagataaaggtgattatgtattcttcaaaactatgtttatcttatggattagcataagagctggatatagcgtgtttgacctatatatataatattgcgtataaagcaagacatacgctttcgtataaaaagccgtacttaatacctataattccttgagtgtcttttgcattttagttacgcaagagacgactgatttcttgtcaaatcttaaaggcatcaatttatttacttgtttaatacgttacacatcgtacattgttgtattgttaattagaatgtataagaaaatgattgtatgctaagttagtaaccgtgtaattcgaaaatatttgactaatgcgtattttctgttttccttttgaaaacatcaaatcccactggccactaggccttaaaatgatcataaccagtcgaattgtataaaacaaatgaccacttgagcagacaaatgaatggtgtgccactttatttttggaacttttgtcgattcatttggaactttaaattgatattttggagcttttcaaaaagtaaatagtgaattgaaacgttcaaacctagaacactagcaagatgaaacattatatgttatcacattacctcattatgtagtaagaaatagtacaattcatatagctttctattaaacatttaaaatgcaagggtttaatgcatcactattacaccattcaaataaagctaaaagaaattaaagtttcaaagttaaattttctttgccactagagcatatacctctaatttgttttgttttttttgtaagatgaaaaaaaaatgtaagcaaagaaaaaaggacagtggtgggtgactctggatgaaaaatgttagtgcaaaatcatgatacacatagtaataattaagggggtcgtaaagttaaaataaacaaaatgcgcggcttgaaaataatataaagcagagttttagtggcgaaatccaatccaagtcaattataagagcatctccatgagtagtctctcacatagtttttcattaactaaaaaatataaaataataataaagtaggagagagatatgagagagattgagaatagtttctctgcagagaaactttagaataatgattgagagactatgtgtatatatgtgtgtttattattggacataaactaaatcatagtaaaatattattatattttttttttgagagactatgtgtatatatgtgtgtttattattggacataaactaaatcatagtaaaatattttttttttttttttgagaaacttttaaagtatcttaccaatggaaatggcctaaacttcctaaaaaaatatattatattcttaaaactatttccaagtttctaatttgaccccacaaaggagaaaaaccaacaaaagggccctttctggtggcatctttatcccaaattacacagtggttttcatattttatatattatctttacatcagagttttttttttcccatcaacatgtatacgtaaaagaaaacaacaaaaattatagcaaaataacccttcttgaatggtaaaatatctcgcagattttatatcataattttatatagtttacgataataaagaaatgtgagactaaataaattcaacgaataggatatacacagaatccagactttggcatccacgcggcataaagaaatagatcgagtgtgatatacaacaaatcacaaatgtgctctcattaattttaaaaaacccaaatctttaatgtattcgtaacgagtctgtcactacattaataataagtcattgaaattgaaatccaccaatagttgcacagaagaattaatatatatttccataactctcataacacaaacttcaccttttaacgaagaagaagatatgttcccaaaacaaacgttttgactttttttttgttttctcatattcttttatttcacaacttgttatttccgccgacttcaccagtcaccaccaccttcatttattcataaatacgtctctgttctgtttttgtttctgtttcattttcatacataattaagccaacacgagacgcaagagagagatagggaaagagataagagcgactctgttttgttgatcaaaatcctttttttttgtttgagggctgaattcacccaccagcaactgctcggatttgtaacctttatctgttttattgagttgtgaaattcagagaaaaaataaatgaagttttgtaagaagtatgaagagtacatgcaaggacagaaggagaagaagaatcttcctggtgttgggtttaagaaactcaagaagattctcaagagatgcaggagaaatcatgttccttctagaatttcttttactgatgcaatcaaccacaattgttctcgtgaatgcccaggtactgttcgacataattaccctgtgaatgaatcatcatcccctgcttttctccttttggtttgagaattcaatattgattttgtagtttgtgatgggacttttttcccggagcttctcaaggaaatggaagatgttgttggatggtttaacgagcatgctcagaagcttcttgagcttcatttagcttctggttttacaaagtgtcttacttggctcagaggcaacagtcgaaaaaaggaccatcatggtttgatccaagagggtaaagatttggttaattacgctctcatcaatgccgtcgccattcgaaaaatcctcaagaaatatgacaaggttgataatcatctactattgtaagatccaaagactgatgatggtctttttaagcacttgtttattcaatatgtttggcatctttgtgttgcagattcatgagtctaggcaaggacaagcgtttaagactcaggtccagaaaatgcgaatagaaatccttcagtcaccgtggctctgcgagcttatggcgtttcacatcaatctgaaagaatctaagaaggaatctggagctactataacttctcctcctcctcctgttcatgcattgtttgatggttgcgctttgactttcgacgatgggaagcctttactttcctgcgagctctctgattccgtcaaagttgacattgacttgacttgttcaatatgcctggtaagaaacttaagaagaatctcaatgtagttgacttattagtaatctgaaatatagaagaaagtatcagcctatagggatagagtcttaactttgtcgtgtcaaggtgttattccactctcctcttgcaggttccacttcaaagactaagtctttagcaatgaatatttttaaatgtaatgctattaataagtctttaacttacggattacaattgattggcgaaaaacaggacacggtgtttgatccaatatctctaacctgcggtcacatatattgctacatgtgtgcttgctctgctgcatcagtaaacgtagttgatggcttgaaaaccgcagaagcaactgaaaaatgcccgctttgccgtgaggttagacacattctccactgctaattacgacttagtagtctactagtcttccttgttttatgcactaaatctctgtattttcgcccattcgatatcaggatggggtttataaaggtgctgttcacttggatgagctcaatattttacttaagcgaaggtaaatgcatatacaaccattcttcttttaatctttaaaacctgtctctaaaaagactgacttacaatttccaaaacctgcaataatgcagctgcagagactattgggaagaaaggcgtaaaacagagagagcagaaaggttacaacaagcaaaggaatattgggattaccaatgccgaagcttcactggaatatgatatagtttgatttgtggcttcttaagtgagattcttgattttgataataagatagtaaaaataatcttaattttgatttgctttcctctgtgagtgtgtttccttgcacagagagtgacgatttctttgtgaaaaaactgaaaactcttaagcattaaatatggtttataagtttgcatatgtcctcttcacctcataaagatgcttctgaatagaaaaaatactgaattctgatttatagaaacttcataaccattgtagtgttgttgcaagtttataacaaaattgaacaaaggatacagagatcatcatcatca

SEQ ID NO: 8752 - DNA, 2100 bp, Arabidopsis thaliana
atggtggcttttgggaaatacttgcagcggaaacaaatcgaagaatggagtggctattatatcaattacaaattgatgaagaagaaagtgaagcaatatgctgaacaaatccaaggcggatctcaacatcctcgccatgttctcaaagatttctcgaggatgctcgatactcagattgagacaactgtccttttcatgttggaacaacaagggttgctttcagggcgattagccaaattgagggaatctcatgatgctatacttgagcagcctgacatatcaagaattttcgagctacgtgaagcatacagagatgttggacgagaccttcttcagctcctgaaattcgttgagttgaacgccattggtctgcgcaagatacttaagaaattcgacaaaaggtttggatatagattcgctgattattacgtgaagacccgcgctaatcacccttactctcagcttcaacaagtttttaagcatgtgggtgttggagctgttgttggagcaatttcccgcaatcttcatgagcttcaagaaaatgaaggaagcttttattcaatttatgaccaacccgttcttccggctcaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcgttactcctgaatctaggaaacacatttttgtacatggtcaacacttatatcatcgtccctacagcggatgactattcgatgagccttggagctgcagcaacggtttgtggtgttgtcatcggatctatggctgtggctcaagtattttcatcggtttatttcagcgcatggtccaacaaatcttacttcaaacctcttgtgtttagcagcatcgcactctttatcggaaatttgatgtatgcgttggcatatgatgccaattccatagcgcttcttttactcggccgtgtctgttgtgggttgggatcagcaagagctgttaaccggagatatatcagcgattgtgtgcctttgagaatccgaatgcaggcatcggcgggttttgtgagtgcaagtgctcttggaatggcttgtggccctgcgcttgccggtttactccaaatcaaattcaagttttacaagtttacatttaaccaatctactttgccgggatgggttatggctgtggcttggctgttctatttggtatggctatgcatttcattcagagagccgttgcgtgacacagaggatggagaaaaaaacaatcgaaatgaaacaacatcagcgacagatagagtagaaagtagcagagtcgaggaaggtcttcgattgccgttgctgatcacttcaggaatcaagccagaagatgaagaggaatgcgatgaaagtgaagaatccccagaagattctcacaaacctgcaaattctttcatagaagcataccgactccttactccatctgttaaggttcaactgttgatctacttcatgctcaaatattcgatggaaatattactgtcagaatcaagtgtcattacttcatactactttagttggacaacaagctctgttgccatcttcctggcctgccttggcctcacggtgctaccaatcaacattttggtcggaagttacatcagtaatatgtttgaagacaggcaaatccttctaacatctgagatcatcgtcttccttgggattctcttcagtttcaatttgtttgttccatacactgtacctcaatacgtaatctctggtctcataatgtttgttgctgctgaagtactcgaaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattga

SEQ ID NO: 8753 - DNA, 7564 bp, Arabidopsis thaliana
tattcatagcaaaaaacactaatctcaatcaccatttcagcaattgacttaattataacttttttatgtttggttctaaacaactttaaacaatattatgatgatatacactaattctatatattgttttaaaaaaaattctagatatttcatgtagcttctacagagttgcatgtcatagtgtactactcaatactttcttacacaggtccacaaatgcacttgcttttgttatgatacttttatataaaatattaattaaacgagtttttttttttgtttgtttatctctgtctagaaagtgaagttacacatgtcgtgaatacatatcgccactagcttaagcattttcttttcttcgcgatcggagaaccttagcaaatcaaaagataagatttaaatgttctaaccactaagaagtaaccccgtagtgatggacattgtgaatgggtgattcttgaatgcaacagctattcggttacctaaacaactaaaatatagtattctttattttgtgtacttctattaaatcaggagaatatctgactgacaccatacataatcatataactgcagataaaatatcggtttttttttgttaaagtgtcgttaagttacttttggttctatagtttgatcaagtgagtatttaaacactactaagtaagttactattggtactagataaaattttggaaatatgtatgtgctgccaattaaattatctgtctcagtggagtgttgcaaatctacaaagtactattgggtattaattagtacacaatagtactttgtagatttacacgtattcatttatttttaacaccagtaattttttttggttacatacttagatgcaacacactaattgaaaaagaaacatgcaaaatacacatgtaatagcaccatgacgaaagtagcatatatgcatcaatagctataatacatgtataaattgataaggaaacaaaagaaatgattggcctagcaaatttaacgagtatcaactttggtcatattttgaaaaacgagtatcacgtgaaatcacggttgtgaatattttaggtaacttatactaaaagcattgtattgtaggtggccaaatatgtgtatataattttctctttattcttggtaactttttttgtccaaccctatttttcattataattttgtccacattctcatcatactaaattactaacgcacatacgcaataagaaaaaaatgtctgccagattattaaatattccactttccaactaaaattgtgtcgctatcttttgtaattatgtaaaaataaaataaaaaaaaacaacgatacaaattgtatacctacacatatgacatgtccattacaataccaataaactgaaggcaaattgaatacgattccatgactttcatttattatacatataaaattagggaagttgtaaataatttaggatttttctcaaaaacaaataatatttcgggttatgtgcttaattagatcatgtgtaattagaacacgtataatatcactatcggaataacgttataaattagtagctatcaacttattatacacataaaattaaggaggttgtaaataatttaggatgtttcataagaataaaataatatttcggatcatgtgcgtaattagatcatgtgtaattctataacaacacgtataatatccctatcataataacgctacatgagtagttttctttattaatatgcagccgtcttaaataatttattcctctttgaccccaaaacttacacattaaccaaaaaacaccccatagaagttttatagaatcacgcaaaaacccccttttacaaaaacgtgccaatttgaggacttaaagcatccacgatttgattgatatttcctcaatgattgggtccgagagtaaatgcgattgataaatgatcacattactcgcgataagagtctgcgatctactataagcaaactagtcgtcttttgattctcctcttcttcacctttttaccaatttcctcgcttacaagattcaaagggtttgtgattgagagaagctttaaaaaacccatctttggtgtttgattctctgtttatttaattcataaaggaaggctcttttttttttgtttatttcaggctccacccaccagcaactgctcggatctcaagaagacaaagttgcgatttttgcaactgggtttctctcttcaggtactgagtttttgttgttgattgtgagaataaaaaggaaagtagacaaaagaagagaatctaggtttttgattgaactccattttagaaaaagttgaaaactttttggcgtttttcatttgtttttcaagttgtggaattttctgaattggcaaaaaaacaattttgtgactactaaagcaacttgtcttggctgcttctttttatcaatcatatatcattgactccactaagatctagtatttatataatattttgtgtaggccttattaccttcatgctaagctcgtgtcttctgatctatttgtaattattttaatctattttttttcagagatttaatctgtataagaagatctcaagatcagcttttgtgtattgaagaagaactaggaagaacgaggatagatacaggtattatttttatatatcaagatctctgcttttggcttatttgtttatcatctttttcacttgaaatgcacgagttttaaagtataaataagctttgtgttcttgttcttgaggctttgtgttgtgtgaagtagaaataagctgaatttggatttgatttgatttggtattaaattgtcctcactggttttgcgtgattatatcatctatgcacatggcttgtagcgctgacttgcttataagtatttttataaaacgtgttgcgttcttgttttggcttctataattgtagttttagaattgtgcttgagcactaatcagattcacagcaattcaaaaatccatttagaggtataattccttttagatgctctttgatcttttcgtgcttgagtcagtttgtacttttgtccttgactctttctaaaacaggttttgtgttaatcccttgaatctgctttatcgcttatgtctcttgaaatctatctatgttgctctctttgtgactgtctgatcattagttgcaaaatgtgaaattgtctgtgtaatgatcaggtcgagttttatgaaatgttgttagcttccattgagtaaggcttattgtggattggtggattgaaatcttcatgtaactataagtattgaggagctttgaatgtggatttaaaactgttctggagtgtcattgactttggatactattattatgtatttgtattaaattcatattatgtatgccacagacccattctctatttccttcaacaagttgacagagagcaaaatctttatatacgtgatatcaaagtgttctaatttccacattcttctcacttctcaggctttaatctaaactttgctctctgctttctgcgattaaaagatggtggcttttgggaaatacttgcagcggaaacaaatcgaagaatggagtgggtatgcatttgcttacgacatctcggttctagccatatcttttgatcatctgatttttttttcctaatgaagttttgataattcccttgtagctattatatcaattacaaattgatgaagaagaaagtgaagcaatatgctgaacaaatccaaggcggatctcaacatcctcgccatgttctcaaagatttctcgaggatgctcgatactcaggtatgttatagataattgtcgagatgatcttgtttgagtattatcctcactgaattgttattttctgtgcatctccgaggttatatatggctacatacgagtaatctcagtccagtgtttgtcattgtttctcttaattagataagacatttaagaaataaaccattctgatgatcagatggaactcctctaaaatgttgttcgagatattgaaagtgaatcattgtttgcagattgagacaactgtccttttcatgttggaacaacaagggttgctttcagggcgattagccaaattgagggaatctcatgatgctatacttgagcagcctgacatatcaagaattttcgagctacgtgaagcatacagagatgttggacgagaccttcttcagctcctgaaattcgttgagttgaacgccattggtctgcgcaagatacttaagaaattcgacaaaaggtttggatatagattcgctgattattacgtgaagacccgcgctaatcacccttactctcagcttcaacaagtttttaagcatgtggtaaatgaatttttcttaccaccctttcactggtttcatctgtaggctcttcttgttaggaatcttaaatgttctgtgtatggaatttgtagggtgttggagctgttgttggagcaatttcccgcaatcttcatgagcttcaagaaaatgaaggaagcttttattcaatttatgaccaacccgttcttccggctcaggtactacatttcaaatatatcaaatcagaatcctctatacaggctttgtaaatcctaatcttttcctcaaaactccacaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcgttactcctgaatctaggaaacacatttttgtacatggtcaacacttatatcatcgtccctacagcggatgactattcgatgagccttggagctgcagcaacggtttgtggtgttgtcatcggatctatggctgtggctcaagtattttcatcggtttatttcagcgcatggtccaacaaatcttacttcaaacctcttgtgtttagcagcatcgcactctttatcggaaatttgatgtatgcgttggcatatgatgccaattccatagcgcttcttttactcggccgtgtctgttgtgggtgagttaaaagttcaatcattttcctatatatcgtgtcaaagaggaaaccttttcctcaactgatttcaaccctttaaatttgcaggttgggatcagcaagagctgttaaccggagatatatcagcgattgtgtgcctttgagaatccgaatgcaggcatcggcgggttttgtgagtgcaagtgctcttggaatggcttgtggccctgcgcttgccggtttactccaaatcaaattcaagttttacaagtttacatttaaccaatctactttgccgggatgggttatggctgtggcttggctgttctatttggtatggctatgcatttcattcagagagccgttgcgtgacacagaggatggagaaaaaaacaatcgaaatgaaacaacatcaggtcattattaatagtaaaagctgtttttcttttctgtctgtaacaattattaacgagtattgaatggattcttggttgatgcagcgacagatagagtagaaagtagcagagtcgaggaaggtcttcgattgccgttgctgatcacttcaggaatcaagccagaagatgaagaggaatgcgatgaaagtgaagaatccccagaagattctcacaaacctgcaaattctttcatagaagcataccgactccttactccatctgttaaggtatcattcatcacttttcttaaacatctgttaagacattgatgaattcttgataaaaagttctcggaatatttcctttaaagttttatctggctgaaagctgtgttgtgcggttctggtcggcaggttcaactgttgatctacttcatgctcaaatattcgatggaaatattactgtcagaatcaagtgtcattacttcatactactttagttggacaacaagctctgttgccatcttcctggcctgccttggcctcacggtgctaccaatcaacattttggtcggaagttacatcagtaatatgtttgaagacaggtaatcttttgaatccgagctcaaaccaaaccaaaaatatcattcatttttttggtgactgatttgcaatttgtgtctcttacaggcaaatccttctaacatctgagatcatcgtcttccttgggattctcttcagtttcaatttgtttgttccatacactgtacctcaatacgtaatctctggtctcataatgtttgttgctgctgaagtactcgaaggtataaactaaacaaacctctgcgttctgttttaaaagaacaactgacttataatgaccctttttggtttctttaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattgattttggagttttgctaccaaattttacaaaatagaataaaacagtgtgtatgatcgatcctctctttgatttgattatttttgttgttctaattcatatgggtgtatatgtgttttataatacatatagtatgtatattcgtatatatacggtgaatatcaaatcctccatttgttggaaattccagttttgtgagattctttttctgaagtattgtaataaattctcatataaatttataagtttttatttggtatctgcttttatataccagttagtccatgcacatccatttctggttctcttgttgaatctgtaactgtgtactctgcatgttttctgagccaattgggttatgttgatatatctgtttatctgactttgacatatacataaattagatattttaatctcatgtaccaccagaccaagactaacatattcaattgtttcaccatctatgattaaccaaaaccttaaatcataccaaaattaaatgttggtgacatatatcgacattttaatttaaattagatttaaagtcttaactgctatgtgtcttggaatgtccatttgaacaatagtattcagcaaaaaaaaaaaaaaaatctatttgttgttatactacaaaaatgttcggagggtgtattatcaagaaaattatatttaattcacttatgaaattgatattcagcaaaaatatgaggtaacgatcttaattttctcaataaactgaatgtaactagctacttgcttactttgataaaaatgataaatatttatattatttatagcttatttccaactaattatgtatagttaggacatgcttttaatcatcaagataaatggatatcaatagtctattaggttattccaatgaaaatgataaatatatattagtttaaaacttatttccaactaataaatatatttacttatttatttagttttatcatcagttggattttaaacccttgatgaaaatactttcaatccc

SEQ ID NO: 8754 - DNA, 1659 bp, Arabidopsis thaliana
atgaatcacccttactctcagcttcaacaagtttttaagcatgtgggtgttggagctgttgttggagcaatttcccgcaatcttcatgagcttcaagaaaatgaaggaagcttttattcaatttatgaccaacccgttcttccggctcaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcgttactcctgaatctaggaaacacatttttgtacatggtcaacacttatatcatcgtccctacagcggatgactattcgatgagccttggagctgcagcaacggtttgtggtgttgtcatcggatctatggctgtggctcaagtattttcatcggtttatttcagcgcatggtccaacaaatcttacttcaaacctcttgtgtttagcagcatcgcactctttatcggaaatttgatgtatgcgttggcatatgatgccaattccatagcgcttcttttactcggccgtgtctgttgtgggttgggatcagcaagagctgttaaccggagatatatcagcgattgtgtgcctttgagaatccgaatgcaggcatcggcgggttttgtgagtgcaagtgctcttggaatggcttgtggccctgcgcttgccggtttactccaaatcaaattcaagttttacaagtttacatttaaccaatctactttgccgggatgggttatggctgtggcttggctgttctatttggtatggctatgcatttcattcagagagccgttgcgtgacacagaggatggagaaaaaaacaatcgaaatgaaacaacatcagcgacagatagagtagaaagtagcagagtcgaggaaggtcttcgattgccgttgctgatcacttcaggaatcaagccagaagatgaagaggaatgcgatgaaagtgaagaatccccagaagattctcacaaacctgcaaattctttcatagaagcataccgactccttactccatctgttaaggttcaactgttgatctacttcatgctcaaatattcgatggaaatattactgtcagaatcaagtgtcattacttcatactactttagttggacaacaagctctgttgccatcttcctggcctgccttggcctcacggtgctaccaatcaacattttggtcggaagttacatcagtaatatgtttgaagacaggcaaatccttctaacatctgagatcatcgtcttccttgggattctcttcagtttcaatttgtttgttccatacactgtacctcaatacgtaatctctggtctcataatgtttgttgctgctgaagtactcgaaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattga

SEQ ID NO: 8755 - DNA, 1070 bp, Arabidopsis thaliana
atggtggcttttgggaaatacttgcagcggaaacaaatcgaagaatggagtggctattatatcaattacaaattgatgaagaagaaagtgaagcaatatgctgaacaaatccaaggcggatctcaacatcctcgccatgttctcaaagatttctcgaggatgctcgatactcagattgagacaactgtccttttcatgttggaacaacaagggttgctttcagggcgattagccaaattgagggaatctcatgatgctatacttgagcagcctgacatatcaagaattttcgagctacgtgaagcatacagagatgttggacgagaccttcttcagctcctgaaattcgttgagttgaacgccattggtctgcgcaagatacttaagaaattcgacaaaaggtttggatatagattcgctgattattacgtgaagacccgcgctaatcacccttactctcagcttcaacaagtttttaagcatgtgggtgttggagctgttgttggagcaatttcccgcaatcttcatgagcttcaagaaaatgaaggaagcttttattcaatttatgaccaacccgttcttccggctcaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcagtttcaatttgtttgttccatacactgtacctcaatacgtaatctctggtctcataatgtttgttgctgctgaagtactcgaaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattga

SEQ ID NO: 8756 - DNA, 2649 bp, Zea mays
ttctcgttcggtcgttttcgttcccctacctccagtccagtcccaggtccgagccggaccttgatcgccgccgtgcctcggcgcaaggaatggggccttcggtcttacccttgcacgcgccgccggcatcaggagacgtctctgtgtgcttcgccgtgccttcagccgtagccggcgccgcatcagcgtgctccagagaggaccgcagcttccagcacgtgtccctgacaccgccccacactggattgggaagggccgctgaccccacgcacctgcccgctggccagtgttggaagtttcagactcagttatttgaaacatcaagatggttaatttcggaaagaaattgatggctgatcaagtggacgaatggaaaggatactacatcaattacaagctgatgaagaaaatgttaaagcaatatgtccaacaaacccaacatgatgagaaagatcgcgaacaagttcttaaagacttttcaaggtttcttgatgaccagattgaaaggattgtgctttttctgctacaacaacaaggccatcttgccagtaggattgagaaattggcagaaaaacgcactgctcttctggaagagtatgacatatcacaagtttatcagctgcatgatgcatacagggaagtcgggcttgatctcataaagcttctccgctttgttgatgtgaatgctactggtatacgcaagatactaaagaaatttgataaacgctttggctacaagttcactgattattatgtcaccactcgtgcaaatcatccttattctcagcttcagcaagtatttaagcaagtgggaattgtagctgttgtaggtgcattatcgcgcaaccttgaatatctgcagcatcatgaaggaagctttgtatccatctatgatcgtccagcagttaccttgaaggaccctattatagaccaagtaaaccatgcagtacagaaactcacgcatgccacgaattttatgcaattcttgggacagcacgcgcttattgtccaggaagatgcagaaagcgagtcggaggatcttgttggtgatcagagctaccatttcatgtccctggtgcttaatctagtgaacacattcctttacatggtgaatacatatatcattgtgccgactgcagatgactatgcagtaagccttggggctgctgcaactgtatgtggtataattattggatcgatggcagtcgcccaagtattctcctcagtctacttcagtgcctggtcaaataagtcctacttcaaacctcttgtgttcagtagcattatgctgtttcttggaaacctactgtatgcattggcatatgatctgaattcactaatagttctcctgactggacgactgctatgtgggttaggttctgcaagagcagtgaaccgtcgctatatcagtgactgtgtgcctctcaagatgaggctacaagcctctgccgggttcgttagtgctagcgctcttggcatggcatgtggccctgctcttgctggttttctccagattaaattcaagatatactcgctcagttttaatcagagcacattgcctggatgggtcatgtgcatttcttggcttatttacttattgtggttgtggcttacattcaaggaaccagaacacttcactaaaactctggtcaatgaacagccgtcagaatctggccgccaaggaaattctaacttggaggcaggtctagctgaaccattgcttcaaggtatagaacgaaggcaggatgagaactcagaagttaatgatgatactgaagtagagtcagaaagctctcatgaaccagcaacatcaattgcttcagcatacagattgctaactccatctgtgaaggcccagctactgatatacttcatgctcaagtacgcaatggaaatactactatcagaatcgagcgttgtcaccacatactattttagctggtctacaagtgctgtggctatctttctagcgattcttggattaacggttcttccagtaaatgccattgttggaagctacgttacaaatttattcgaggataggcaaattttgttggcatctgaagtcatggttctcatcggtataatcatgagcttttgtttcacacctcactactccatcccgcaatatgttctttcagctttcatcacatttgtatttgctgaggtgcttgaaggagtgaatctgtccttgctctcacgagtaatgtcatcgaggctttcccgagggacctacaatggtggactcctttcgacagaggccgggacgttggcccgtgtagttgcagatgccacgattactgcagccggttatctcggcacggacctccttctgaatgtcactcttctcccatcccttgtgatttgcatagtctccatcgcagcagcactctacacttacaacaatctctattgaagctattgttgctgtacaagtgtacaacaatgttcctaagctaaaatgttcctgcccacaacgggtttgtatatctgttcaagcatggtttgtaaacattttgatcaagtttgtatgcaaaatttcttgtatttagtgcatttatgtaaagattcatcctgtaaagaattataaactatgagacgctattgccatttatgatcatttatgtttatctttttagccttatgtta

SEQ ID NO: 8757 - protein, 696 aa, Zea mays
MVNFGKKLMADQVDEWKGYYINYKLMKKMLKQYVQQTQHDEKDREQVLKDFSRFLDDQIERIVLFLLQQQGHLASRIEKLAEKRTALLEEYDISQVYQLHDAYREVGLDLIKLLRFVDVNATGIRKILKKFDKRFGYKFTDYYVTTRANHPYSQLQQVFKQVGIVAVVGALSRNLEYLQHHEGSFVSIYDRPAVTLKDPIIDQVNHAVQKLTHATNFMQFLGQHALIVQEDAESESEDLVGDQSYHFMSLVLNLVNTFLYMVNTYIIVPTADDYAVSLGAAATVCGIIIGSMAVAQVFSSVYFSAWSNKSYFKPLVFSSIMLFLGNLLYALAYDLNSLIVLLTGRLLCGLGSARAVNRRYISDCVPLKMRLQASAGFVSASALGMACGPALAGFLQIKFKIYSLSFNQSTLPGWVMCISWLIYLLWLWLTFKEPEHFTKTLVNEQPSESGRQGNSNLEAGLAEPLLQGIERRQDENSEVNDDTEVESESSHEPATSIASAYRLLTPSVKAQLLIYFMLKYAMEILLSESSVVTTYYFSWSTSAVAIFLAILGLTVLPVNAIVGSYVTNLFEDRQILLASEVMVLIGIIMSFCFTPHYSIPQYVLSAFITFVFAEVLEGVNLSLLSRVMSSRLSRGTYNGGLLSTEAGTLARVVADATITAAGYLGTDLLLNVTLLPSLVICIVSIAAALYTYNNLY

SEQ ID NO: 8758 - DNA, 1372 bp, Zea mays
cctccctttgggctagtaatttgtctatattgtttaaggttcttgattttctgacggtgcatctgtgatcgagctgccagcatgtaatgtgcaggttaggttctgcaagagcagtgaaccgtcgctatatcagtgactgtgtgcctctcaagatgaggctacaagcctctgccgggttcgttagtgctagcgctcttggcatggcatgtggccctgctcttgctggttttctccagattaaattcaagatatactcgctcagttttaatcagagcacattgcctggatgggtcatgtgcatttcttggcttatttacttattgtggttgtggcttacattcaaggaaccagaacacttcactaaaactctggtcaatgaacagccgtcagaatctggccgccaaggaaattctaacttggaggcaggtctagctgaaccattgcttcaaggtatagaacgaaggcaggatgagaactcagaagttaatgatgatactgaagtagagtcagaaagctctcatgaaccagcaacatcaattgcttcagcatacagattgctaactccatctgtgaaggcccagctactgatatacttcatgctcaagtacgcaatggaaatactactatcagaatcgagcgttgtcaccacatactattttagctggtctacaagtgctgtggctatctttctagcgattcttggattaacggttcttccagtaaatgccattgttggaagctacgttacaaatttattcgaggataggcaaattttgttggcatctgaagtcatggttctcatcggtataatcatgagcttttgtttcacacctcactactccatcccgcaatatgttctttcagctttcatcacatttgtatttgctgaggtgcttgaaggagtgaatctgtccttgctctcacgagtaatgtcatcgaggctttcccgagggacctacaatggtggactcctttcgacagaggccgggacgttggcccgtgtagttgcagatgccacgattactgcagccggttatctcggcacggacctccttctgaatgtcactcttctcccatcccttgtgatttgcatagtctccatcgcagcagcactctacacttacaacaatctctattgaagctattgttgctgtacaagtgtacaacaatgttcctaagctaaaatgttcctgcccacaacgggtttgtatatctgttcaagcatggtttgtaaacattttgatcaagtttgtatgcaaaatttcttgtatttagtgcatttatgtaaagattcatcctgtaaagaattataaactatgagacgctattgccatttatgatcatttatgtttatctttttagccttatgtta

SEQ ID NO: 8759 - protein, 350 aa, Zea mays
MCRLGSARAVNRRYISDCVPLKMRLQASAGFVSASALGMACGPALAGFLQIKFKIYSLSFNQSTLPGWVMCISWLIYLLWLWLTFKEPEHFTKTLVNEQPSESGRQGNSNLEAGLAEPLLQGIERRQDENSEVNDDTEVESESSHEPATSIASAYRLLTPSVKAQLLIYFMLKYAMEILLSESSVVTTYYFSWSTSAVAIFLAILGLTVLPVNAIVGSYVTNLFEDRQILLASEVMVLIGIIMSFCFTPHYSIPQYVLSAFITFVFAEVLEGVNLSLLSRVMSSRLSRGTYNGGLLSTEAGTLARVVADATITAAGYLGTDLLLNVTLLPSLVICIVSIAAALYTYNNLY

SEQ ID NO: 8760 - DNA, 2664 bp, Zea mays
ccctccccttcccctgccactctccgcctctggcctagcgcccccgcccgctcgatccgcctagtaggtaacggcgaggctcaccgcgtccgcactcgcccgtgaatccgtgatttctcccaccttcctttcagcgccgctctcccaccttcctttcagcgccgcccgccgtccttttcgatcagtatttaaaaatcaagatggttaacttcgggaagaaattgatggcagatcaaattccagaatggaaaggatattatatcaattacaagttgatgaagaagaaagttaaacagtatggccagcagctccagcagggggaaaaagatcgtcgtcgggttctgaaggatttctcgaagatgcttgatgatcagatagagaagatcgtcctgtttctgttggaacaacaaggactattggcaagcaggattgagaagttaggaaagcaaagggcaatactacaagagcagccagatatatctggcattgctgagttacgagaagcttatagggaagttggtatcaatctcatcaaacttctcaagttcgttgaccttaatgcaactggcattcggaaaatcttgaagaagtttgataagcgttttggctatagatttactgattactatgtgacaagtagatcgaatcacccttactctcagctgcaacaggtctttaagcatgtgggtgtaggagctgttgtaggagctttgtcacgtaaccttgctgaactccaagaacgtcaaggaagctacttatctatttatgatcagccatcttctgctcttaaggaccccatcattgatatgataaattcttcagttgataagttgacaaggtcaactaattttcttcgctttttggggcaacatgccatgattgtggatgaggagtctcctagcactgcaggagaggaagaaatagaagatcagaaataccatttcatgtcccttatgctgaacctggtgaacacattcctttacatggtcaacacgtacatcattgtgccaactgcagatgactattcagtgagccttggggcagcttctactgtttgtggtgtggtcattggttcaatgactgttgcgcaaatattttcctctatttacttcagtgcatggtccaacaagtcatatttcaaaccgcttgttttcagtagcattgttttgttcttggggaatatatgctatgctatggcatatgatatgaagtctctaacggtccttattatcggccgtttactctgtgggatgggttctgcaagagctgtcaatcgccgatatattagtgattgtgtccctgcaaggatacgcatgcaagcttcggctggatttgttagcgcaagtgcacttggcatggcctgtgggccagcgctagctggtttacttcagtggaaattcaaggtctacatggttacattcaatcaatcgactctaccgggttgggtgatggcagttgcatggctattgtatttgatttggctatggttctcattcaaagaaccgaaccgtgctaccgaggtgaatgaagccccacaaaatcctgcttctggacaaactgttgatattggacgactagagaatggaattgcacagcctctgctcaaggattccgtggataaacaaaatgaagatgaagacgaagttgatgatattgaagaaactgcagatgattctcgcaaacctgcaacatcaattggctcagcataccgattgcttaccccgtcagtgaaggtccagttgttgatatacttcatgctcaaatacgcaatggagattttgctttcggagtcgagtgttatcaccaatcactatttcagttggaatacaagcgcagtggcaatatttctagcaatcctagggttgacagtccttcctgtaaacgctgttgttggaacatacatcagcaatatgtttgaggacaggcaactcctcatggtgtctcaaattacgttgctagtaggcattatcttcagcttcaaagtcacgagcacatactatgtcgtccagtatgttgtctcagcactggtcacatttgtttctgccgaagttcttgaaggcgtcaacctttccctcctatcgagcgtgatgtcgtcccgcctctcccgtggcacgtacaacggtggtctcctctcgacggaggctgggaccctggccagggtggtcgccgactgcaccatcaccgcggcggggtacctgggcgtggggaagctcctcaacgtcaccctgctaccgtcgctggtgatatgtgttgcgtccatcgcctgcaccttcctgacgtacaactcgcttttctgatggagcttcgcgacgtatttgtgtcgtcatgattcgttccaaatcaaggcagctgggagaccgccgttgccattgcccgaaggggctgttgtgttattatattatatatgtgcgtcgatttgattgctgtaaattgacaaaatgatggcagccactggccttgccctgcaaaattttgatcgcttatgtccgtgacgttgtcaatgctatgttgtgttgacgtgttggtccaaactgtaattatgctactctcgactgatctgatctccgctgcgatgcggttttgagagtggagtcgtacgagagtggatcggcgtttttgtccattgggcttgattggatttatgagataaatagtttgtcggct

SEQ ID NO: 8761 - protein, 698 aa, Zea mays
MVNFGKKLMADQIPEWKGYYINYKLMKKKVKQYGQQLQQGEKDRRRVLKDFSKMLDDQIEKIVLFLLEQQGLLASRIEKLGKQRAILQEQPDISGIAELREAYREVGINLIKLLKFVDLNATGIRKILKKFDKRFGYRFTDYYVTSRSNHPYSQLQQVFKHVGVGAVVGALSRNLAELQERQGSYLSIYDQPSSALKDPIIDMINSSVDKLTRSTNFLRFLGQHAMIVDEESPSTAGEEEIEDQKYHFMSLMLNLVNTFLYMVNTYIIVPTADDYSVSLGAASTVCGVVIGSMTVAQIFSSIYFSAWSNKSYFKPLVFSSIVLFLGNICYAMAYDMKSLTVLIIGRLLCGMGSARAVNRRYISDCVPARIRMQASAGFVSASALGMACGPALAGLLQWKFKVYMVTFNQSTLPGWVMAVAWLLYLIWLWFSFKEPNRATEVNEAPQNPASGQTVDIGRLENGIAQPLLKDSVDKQNEDEDEVDDIEETADDSRKPATSIGSAYRLLTPSVKVQLLIYFMLKYAMEILLSESSVITNHYFSWNTSAVAIFLAILGLTVLPVNAVVGTYISNMFEDRQLLMVSQITLLVGIIFSFKVTSTYYVVQYVVSALVTFVSAEVLEGVNLSLLSSVMSSRLSRGTYNGGLLSTEAGTLARVVADCTITAAGYLGVGKLLNVTLLPSLVICVASIACTFLTYNSLF

SEQ ID NO: 8762 - DNA, 1558 bp, Zea mays
caattgcaaagatctcaagtaatgtgatttcttatgagcttttttaatgacaaaaagaatcttgcactaaattcatttgtgtttacatctttttggaaatgctcatgttttcatgttctaatgtgctcaatattttgatacaggatgggttctgcaagagctgtcaatcgccgatatattagtgattgtgtccctgcaaggatacgcatgcaagcttcggctggatttgttagcgcaagtgcacttggcatggcctgtgggccagcgctagctggtttacttcagtggaaattcaaggtctacatggttacattcaatcaatcgactctaccgggttgggtgatggcagttgcatggctattgtatttgatttggctatggttctcattcaaagaaccgaaccgtgctaccgaggtgaatgaagccccacaaaatcctgcttctggacaaactgttgatattggacgactagagaatggaattgcacagcctctgctcaaggattccgtggataaacaaaatgaagatgaagacgaagttgatgatattgaagaaactgcagatgattctcgcaaacctgcaacatcaattggctcagcataccgattgcttaccccgtcagtgaaggtccagttgttgatatacttcatgctcaaatacgcaatggagattttgctttcggagtcgagtgttatcaccaatcactatttcagttggaatacaagcgcagtggcaatatttctagcaatcctagggttgacagtccttcctgtaaacgctgttgttggaacatacatcagcaatatgtttgaggacaggcaactcctcatggtgtctcaaattacgttgctagtaggcattatcttcagcttcaaagtcacgagcacatactatgtcgtccagtatgttgtctcagcactggtcacatttgtttctgccgaagttcttgaaggcgtcaacctttccctcctatcgagcgtgatgtcgtcccgcctctcccgtggcacgtacaacggtggtctcctctcgacggaggctgggaccctggccagggtggtcgccgactgcaccatcaccgcggcggggtacctgggcgtggggaagctcctcaacgtcaccctgctaccgtcgctggtgatatgtgttgcgtccatcgcctgcaccttcctgacgtacaactcgcttttctgatggagcttcgcgacgtatttgtgtcgtcatgattcgttccaaatcaaggcagctgggagaccgccgttgccattgcccgaaggggctgttgtgttattatattatatatgtgcgtcgatttgattgctgtaaattgacaaaatgatggcagccactggccttgccctgcaaaattttgatcgcttatgtccgtgacgttgtcaatgctatgttgtgttgacgtgttggtccaaactgtaattatgctactctcgactgatctgatctccgctgcgatgcggttttgagagtggagtcgtacgagagtggatcggcgtttttgtccattgggcttgattggatttatgagataaatagtttgtcggct

SEQ ID NO: 8763 - protein, 348 aa, Zea mays
MGSARAVNRRYISDCVPARIRMQASAGFVSASALGMACGPALAGLLQWKFKVYMVTFNQSTLPGWVMAVAWLLYLIWLWFSFKEPNRATEVNEAPQNPASGQTVDIGRLENGIAQPLLKDSVDKQNEDEDEVDDIEETADDSRKPATSIGSAYRLLTPSVKVQLLIYFMLKYAMEILLSESSVITNHYFSWNTSAVAIFLAILGLTVLPVNAVVGTYISNMFEDRQLLMVSQITLLVGIIFSFKVTSTYYVVQYVVSALVTFVSAEVLEGVNLSLLSSVMSSRLSRGTYNGGLLSTEAGTLARVVADCTITAAGYLGVGKLLNVTLLPSLVICVASIACTFLTYNSLF

SEQ ID NO: 8764 - DNA, 2337 bp, Zea mays
ctcgaggccggccggggcgccgcctctcgccgggggcggctcacggctaccggctgctgccacccgcgcccgtctctcttccatagtttcacctcgttcgcctggctataaatacccgcatcccgttgctctcgcggcccctccatccctcccgacggcatccccttcccctgccactcgcctccgctccgcgcagattagtattttaaactcaagatggttaacttcgggaagaaattgatggctgatcaaattccagaatggaaaggatattatatcaattacaagttgatgaagaagaaagttaaacagtatggccagcagctccagcagggcgagaaagatcgtcgccgggtcctgaaggatttctcgaagatgcttgatgatcagatagagaagattgcgctgtttctgttggaacagcaaggaatgttggcaagcaggattgaggagttaggaaagcaaagggcaatactacaagaccagccagatatatctggtattgctgagttacgagaagcttatagggaagttggtattgacctcatcaaactccttaaattcgttgatcttaatgcaactggcattcggaaaattttgaagaagtttgacaagcgtttcggctatagatttactgattactatgtgacaagtagatcaaatcacccgtactctcagctgcaacaggtctttaagcatgtgggtgtaggagctgttgtaggagctttgtcacgtaaccttgctgaacttcaagaacgtcaaggaagctacttatctatttatgatcagccatcttctgctcttaaggaccccatcattgatatgataaactccccagttgataagttgacaaggtcaactaattttcttcgctttttggggcaacatgccttgattgtggatgaggagtctcctagtactgcaggagaggaagaaatagaagatcagaaataccatttcatgtcccttatgctgaacctggtgaacacattcctttacatggtcaacacatacatcattgtgccaactgcagatgactattcagatgggttctgcaagagctgtcaaccgtcggtacattagtgattgtgtccctgcaagaatacgcatgcaagcttcggcaggattcgttagcgcaagtgcacttggcatggcctgtgggccagcgctagctggtttacttcaatggaaattcaagatctacatggttactttcaatcaatcgactctacctggttgggtgatggcagttgcgtggctattgtatttgatttggctatgggtctcattcaaagaaccgaaccgtgctactgaggtgaatgaagccccacaaaatcctgcttctggacaaacggttgatattggacaagtagagaatggacttgctcagcctctgctcatggattccgtagataaacaaaatgaagatgaagatgaagaagttgatgaaagtgaagaagctgcagatgattcacgcaagcctgcaacatcaattggctcagcatacagactgcttactccatcagtaaaggtccagttgttgatatacttcatgctgaaatacgcaatggagattttgctttcagagtctagtgttatcactaatcactatttcagttggaacacaagcgcagtggcaatttttctagcaatccttgggttgacggtgcttcctgttaatgctgttgttggaacatacatcagcaatatgtttgaggacaggcaactcctcatggtctctcaaattacgttgctagtaggcattatcttcagcttcaaggttacgagtacatactctgttgtccagtatgttgtctcagcacttgtcacatttgtttctgcagaagttcttgaaggtgtgaacctttccctcctatcaagcgtgatgtcatctcgcctctcccgtggcacatacaacggtggcctcctctcgacggaggccgggaccctggcgagggtggtcgctgactgcaccatcactgcggcggggtacctgggcgtggggaagcttctcaacgtcaccctgctaccatccctggtgatatgtgttgcgtccattgcctgcaccttcctgacgtataactcgcttttctgatggagcttcacaatgtatttgtgtcatcatgattcgttccatattagcgcaaatcaaggcagctgggagaccgccattgccattgcccgaaggggctattgtattactattattatatgttcgtcgatttaattgctgtaaattgattgataaaatgatggtagctactgaacctggtcttgccgtgcaaaattttgaccgactctatccttgtcatgaatacatgctgtccatattatggc

SEQ ID NO: 8765 - protein, 625 aa, Zea mays
  misc_feature (276)..(276): Xaa can be any naturally occurring amino acid
MVNFGKKLMADQIPEWKGYYINYKLMKKKVKQYGQQLQQGEKDRRRVLKDFSKMLDDQIEKIALFLLEQQGMLASRIEELGKQRAILQDQPDISGIAELREAYREVGIDLIKLLKFVDLNATGIRKILKKFDKRFGYRFTDYYVTSRSNHPYSQLQQVFKHVGVGAVVGALSRNLAELQERQGSYLSIYDQPSSALKDPIIDMINSPVDKLTRSTNFLRFLGQHALIVDEESPSTAGEEEIEDQKYHFMSLMLNLVNTFLYMVNTYIIVPTADDYXMGSARAVNRRYISDCVPARIRMQASAGFVSASALGMACGPALAGLLQWKFKIYMVTFNQSTLPGWVMAVAWLLYLIWLWVSFKEPNRATEVNEAPQNPASGQTVDIGQVENGLAQPLLMDSVDKQNEDEDEEVDESEEAADDSRKPATSIGSAYRLLTPSVKVQLLIYFMLKYAMEILLSESSVITNHYFSWNTSAVAIFLAILGLTVLPVNAVVGTYISNMFEDRQLLMVSQITLLVGIIFSFKVTSTYSVVQYVVSALVTFVSAEVLEGVNLSLLSSVMSSRLSRGTYNGGLLSTEAGTLARVVADCTITAAGYLGVGKLLNVTLLPSLVICVASIACTFLTYNSLF

SEQ ID NO: 8766 - protein, 353 aa, Zea mays
MTIQMGSARAVNRRYISDCVPARIRMQASAGFVSASALGMACGPALAGLLQWKFKIYMVTFNQSTLPGWVMAVAWLLYLIWLWVSFKEPNRATEVNEAPQNPASGQTVDIGQVENGLAQPLLMDSVDKQNEDEDEEVDESEEAADDSRKPATSIGSAYRLLTPSVKVQLLIYFMLKYAMEILLSESSVITNHYFSWNTSAVAIFLAILGLTVLPVNAVVGTYISNMFEDRQLLMVSQITLLVGIIFSFKVTSTYSVVQYVVSALVTFVSAEVLEGVNLSLLSSVMSSRLSRGTYNGGLLSTEAGTLARVVADCTITAAGYLGVGKLLNVTLLPSLVICVASIACTFLTYNSLF

SEQ ID NO: 8767 - DNA, 10991 bp, Zea mays
gttacaaggcaatatttttgtagaataaaatcttaaaggaaactcaactccacgaattggtcacttgcattaaatcatattgtgggtctcttttagttgcatcttaagatggcggcaacaagatttcaagcactttttatctagtgaccgcaatgcactggagataaataagaatccaaatattatttttgataaccttgacactatttaaatcttcttataagtgacgaagtagtttgatcaacaataaaaacgtatagatttcaacattttttgcgattgtaggatatatgttagcaaatattttaagcaaaataatatttttatctataatctctatatggattattctagattttggggaccctatataaaattagctatgagtattaacacttgataatcttgcctagaatgtcttcgatttctgggtctaccactacacctaactgagtttaaccctgcaataaataattaatctcgtgaaatcatttggagattttgactcaatttaaataggtagctactgtgtagttaggttgaaccaggacaccaggtgtaacacgagtcacatatgcatgcatgtgtattgactcaatcggccggcgcacgctatgatggtgctagaaaatgttttatacggctgtgaaaggtgtaacctgtgctgtgtcgcaaacaatatattgtttaactttgtttggccttgaactcctgggggcaaacataagatataaaagatcgatatgcctttcatgattccgtcataatctcgaccgtaattaaggcccgctctatataaacctttaaagcaaattgttagtcatataataatttattagttggattgatgcaacaaataacaactatttatttaagattaactaacttctcagttaaatttagtcactaactattagttttagaggtttggaacatgttataagaacctaaccggtctctcaacgttacaaaagctatcatatttgaacccccgtcatcggagcgcacacgttttattttgttctgttcatgtctatgctgagatactaaaattttgtgcacaagactacaaggacgagagcacctaatgaggtattaatcggttattcaaattccgtaagagttgggggtattggaagagattattagaatttttgacctgttaagatttaaacccacttaatttcttgcaacacatactgcaggtcctcagatagcgaggcgcagtcgcgcagaccgcagagcgccgaatcgtgagaaggatcagaagtgcttgttacttccgtacgggttagagcatctccaacaacgtgacctataaaaatgccctataatttgaaaatgagtatattttatagaatttagggcaccaacaaaacaccccgctccaacagtaaagccccaaatctagattatagggcagcccactacggtgtagtatatttgagtcacttgagagggtgccctatagttttttgacaaaattttatgaaatggagcactgttggagtagtttttcctgtgtagagccctatatttcaatttgaggcactagtttgaggcattgttggagatgctcttacaaatacacggaacatatttgggttcagcaacagggacggacggacggcgcgccgtgttctacagacttgccgtcgctgcttctgcatctgttcgaaaaccgtaacccccgtgcaccgctggtcagtagtcgtcgtttcgtttcgtttcgtttcgtcgcggcgatcttcgaaccgatgaagcgtggcacttggctggttggtggtggtacgccgggccagaaggtgacctgcctcgatccgaataccatgcatcgatctgtgcacgtgcctgttctcttcctactccgattaccgatagtccgggccgggaaaaagagcgcgaagccagatctgaccactaggggtctgtttggttggtttctctcgccaacctggctgtgtgagccaggatcactggagcctggctctgaagatacgaccaatctgctcgtatctggtgagcctggcccaaggtgctttaaggatcgtgcgagtctggattcaaatctacatgcagacaaccaaacacagagctcgcacgcgcatagcttggctcatagcaaccaaacagcagctacccgcatcccgcgacgcaagcacgcgcagatgcaggcaaccaaacagaccccaggtgatccaggtcgtcgaatgttccacgcgaaccgcagccgcgagtgccgtctccggctccgccacaggtagagctcagagcagaaaatgctccagccacctgtctctcttcttcctccttcctgccctgcacgcggctataagtacccaccgccatctcactttgcccagcagcacggcagtagctgcgccattgcacgcctccggccggcggctgcttgtcttgctgcttctgccgcacatccgtgatccgtacgtcgtcacctcaccactcacgcacaagcacaaagagcgttaatttcttgctggagattctattctatttctatggcgtgtccctgatcgaatcctaaatcctaaacctctgtggtgcactgcagggcagaaggtgcttcgttcgttgcaggcctggcgccacgccgtaccgtgcaagcgcgtttgctgatgttcatctaattactgtataataatatctccgggcgaaagagctagcaatcgtcggcgggggaggaggggctcgattgctgctcaaggtgagttgtaattccttggctctggatttccctatctgttggctgttcatggatcatccaatggatggatggcgctccctgttctctacacctgcgtgctcttcttccctcgcctcgccggggtcttgtgtcagttactgtatctccctgttgattttaaaatctaagaagcaacaacaaaagatgattcaaaaaaatattcaaatttgaaggaccacaatgcgtgtgctactgctagctatgctaccattagagcatgccttcactgcattcttcttcttttgttacgagtgcttaatctcatggctcgctcccttaattcttgctaccattagagcatcttcaatactttctaaaaaaaaccacttgacaaactaatgaaatcagttggtaaactaataagtttcacgagtgactaaaaaaaagataggagctagcttctagtcctagataatgctcttatgagctttccttgtccagttgtcccaactcccaacgaacaaaaaaaaaaaggtaagaaaacacatttggcctttcttcttttttcttttcaactcaaaacgatcgctcagttacaaaaaaaaaagagagcttgcaattgcgagcgagataccaccgttacagggaaaaaaaagacaagttgttcaagttctctactagcttcctagcgcttccgtgtcgttctagatgagcttctctagcaaaggacaataatttggttgccacgtcagatgtcgactcagtgtcatttgctaccagctggcttatcaacttgggagattattgctcgcacctggacccggtgtccagtcaattattaatgatgttgatccatcttcgtatttttatcttggcaagaaactgttagtattaagttactgtcacctttggaagctgaatctcccctcgaagatatcagtatgggcatatagccatccgttcttatacacagctatttacgtctattttacaattttatatcttcgtcttcctcttttacacctacattcgaaccatctatttagagctttcaatgtgcaattcgtctttggtcattgtcaacatgaaccgtccagtgataatgctttgatgctgactaagaagtacggtctccggttcttaaatatttattgtctaatatttatttttaaaataaaacatgataaataaaaaagaacggagtgagtagaatacattgtgagctgttgttggtttgttgcacattctttacttgtttttttttacgaacatttgttgcaagcatcagcaaagccgtataaacttgtgcagctctagatagcgatttttttaaacaaaaccttaatattagattttggagcattgatttagaaagctgagcaactccaatgggagaggtgtttattttctcgtccatccacatccgccgttggcccgttgtttcttttctacccgcgcctgtggggcccaaccgtccggtcaaccgaccagcgtttcctgttccaccgtacgtcgtcgttctcgttcggtcgttttcgttcccctacctccagtccagtcccaggtccgagccggaccttgatcgccgccgtgcctcggcgcaaggaatggggccttcggtcttacccttgcacgcgccgccggcatcaggagacgtctctgtgtgcttcgccgtgccttcagccgtagccggcgccgcatcagcgtgctccagagaggaccgcagcttccagcacgtgtccctgacaccgccccacactggattgggaagggccgctgaccccacgcacctgcccgctggccagtgttggaaggtttgggaaatgagatgttgattttaagctgacttttgagggttttagcttacagctttttaaatcaatcttcgaccaacggtttgaaattccgtgtttagagttgaattactcgattcagaagtttaagtttctctaatttaagctaaagggagaagagatggagcgcctggcttgagttggccgcacgcagctgggaagaaggatctgaaaacactgtcgtccatgtattgattcacttaaacatttgtccgtatctattattttaatttttttataatctacggtcacaagatatgcctgtgttgtttgtgaatagaaaacactgaacaatgattgtgagtcaacagctatcattatttgtgttttggttgtgcgagggtatactaatgtctaatgattggctaaaccttagtcttacatcgctgtctttccttgcgctgtagggcaaggcaaccaccaattgggtaaaagcatataagcaggcttaccgatcaataaatataaaaaagggtagctttcaagaagtctgcttatgtaataccattattttccttttttttacctcgaaggagtgataatcaccaaaatagcattatattgtcatcatacggctgcactatctttttcttctgtaacatgccgtctaattattatcttcagtttcagactcagttatttgaaacatcaagatggttaatttcggaaagaaattgatggctgatcaagtggacgaatggaaagggtatgacttttcttttggtacttatgaaatcatctatttttatcttatcagggcaaatgttctttattttcatatatgcccactccactagtccactaggatacattagaacaccataccgtagttatcaccatatcacagtccttactatcattatctggttaattttataattaaattaaacaaaatctagcagttatcgaattgataggttgcactacaataatgaagtcacttcccgctaatgcaagctaatgtcactttgtttaacggtttatcagaaatcttatcagctttttggtctttccatttctagatactacatcaattacaagaaatcttatcagctttttggtctttccatttctagatactacatcaattacaagctgatgaagaaaatgttaaagcaatatgtccaacaaacccaacatgatgagaaagatcgcgaacaagttcttaaagacttttcaaggtttcttgatgaccaggtatacaaagaaagatttcccttgaaatgatcataatatatgattttgagcatcatctatcctgtcagtagtcacttgtatccttgtaaggaacagaacagtgtcatgcgacaagcttaatagtcttagtgaattgggatcatttttcttagttgtgagctaaaatacacatgtatttcttcgttccagattgaaaggattgtgctttttctgctacaacaacaaggccatcttgccagtaggattgagaaattggcagaaaaacgcactgctcttctggaagagtatgacatatcacaagtttatcagctgcatgatgcatacagggaagtcgggcttgatctcataaagcttctccgctttgttgatgtgaatgctactggtatacgcaagatactaaagaaatttgataaacgctttggctacaagttcactgattattatgtcaccactcgtgcaaatcatccttattctcagcttcagcaagtatttaagcaagtggtaattttcatgcattttgcattttcctttcttgatgtgtgaagtaattcccagtacctattatttatcatggactcatacggatgcagggaattgtagctgttgtaggtgcattatcgcgcaaccttgaatatctgcagcatcatgaaggaagctttgtatccatctatgatcgtccagcagttaccttgaaggtattctattttcactattccattctcatttcagaaattctgctattgaatttataaatgaaaaccttgaaaggtgctctttcttacctcggaactgcatcaattatatttccacatgaagtagggtgtgacatgacacttttttgttgttatattcaggaccctattatagaccaagtaaaccatgcagtacagaaactcacgcatgccacgaattttatgcaattcttgggacagcacgcgcttattgtccaggaagatgcagaaagcgagtcggaggatcttgttggtgatcagagctaccatttcatgtccctggtgcttaatctagtgaacacattcctttacatggtgaatacatatatcattgtgccgactgcagatgactatgcagtaagccttggggctgctgcaactgtatgtggtataattattggatcgatggcagtcgcccaagtattctcctcagtctacttcagtgcctggtcaaataagtcctacttcaaacctcttgtgttcagtagcattatgctgtttcttggaaacctactgtatgcattggcatatgatctgaattcactaatagttctcctgactggacgactgctatgtgggtatgcaattttctcaattcactctatctcacttgatttacgttccacttttgtatgctagcattgatctgggtgaaaattactagtatgacaaatgcaggttgaggatccttaagctgagggcaatattctagaatatttatattgctgaatagaaaacaaaatggaaactgtatatcttacaaggagataaaggattttaaatctcgagactggcattaaaatatatgcttttctatttcttttatagaacttaactagttatccctacctccctttgggctagtaatttgtctatattgtttaaggttcttgattttctgacggtgcatctgtgatcgagctgccagcatgtaatgtgcaggttaggttctgcaagagcagtgaaccgtcgctatatcagtgactgtgtgcctctcaagatgaggctacaagcctctgccgggttcgttagtgctagcgctcttggcatggcatgtggccctgctcttgctggttttctccagattaaattcaagatatactcgctcagttttaatcagagcacattgcctggatgggtcatgtgcatttcttggcttatttacttattgtggttgtggcttacattcaaggaaccagaacacttcactaaaactctggtcaatgaacagccgtcagaatctggtaagctaacaatacactgaaatggcaacatgttttgtttgaattcatgaatatgctcgaatcaaaccttattgtacaatcaggatgtgtatgcttatcattcttaggaacttttctgagatgtttatttccttattatgaaaataggccgccaaggaaattctaacttggaggcaggtctagctgaaccattgcttcaaggtatagaacgaaggcaggatgagaactcagaagttaatgatgatactgaagtagagtcagaaagctctcatgaaccagcaacatcaattgcttcagcatacagattgctaactccatctgtgaaggtttccttccccctcccttcccaattatcgatttttctttgtcttgttcttggttcaaacgtttgaaagaaagaagctcacaatctacatagggttcttttgtaaataaagttagataaattaactatataatataataaaactgcatctttaaatagtaatgggtaaatacattccagttactagtaggtacatctgcatgtcatacaagcaaacataacggacacgccatgtaaaagaaactaggccaacctaggagaaactaggttgcatttattattatattattattaagatgaaaataggcacccaaatttaccttgacaaggacttgaacctaggtggtctgggtttacgagcacacccttgaccaagtgagctagctcagttcccttgacacaccagccagatgaaaagttgcatgtgcagctacccctttttccacgcccttttcatcttccaatctttgttggagctaccttctcatgtattcatatctttaaaaaatggttgtttgtcaggcccagctactgatatacttcatgctcaagtacgcaatggaaatactactatcagaatcgagcgttgtcaccacatactattttagctggtctacaagtgctgtggctatctttctagcgattcttggattaacggttcttccagtaaatgccattgttggaagctacgttacaaatttattcgaggataggtaagctttgtactcttacaaaacatactacatgaaacttttatattctctagacattgtttttctcttaaactgagacatgctttcacaaaataagaacttgctctatcatttgcaggcaaattttgttggcatctgaagtcatggttctcatcggtataatcatgagcttttgtttcacacctcactactccatcccgcaatatgttctttcagctttcatcacatttgtatttgctgaggtgcttgaaggtatgtatgtttatatacattaatggtttgagacagcgaaacctaaatcaatcatacgctgctgatttatcagccactcaacttctaacctcgagctatgcaggagtgaatctgtccttgctctcacgagtaatgtcatcgaggctttcccgagggacctacaatggtggactcctttcgacagaggccgggacgttggcccgtgtagttgcagatgccacgattactgcagccggttatctcggcacggacctccttctgaatgtcactcttctcccatcccttgtgatttgcatagtctccatcgcagcagcactctacacttacaacaatctctattgaagctattgttgctgtacaagtgtacaacaatgttcctaagctaaaatgttcctgcccacaacgggtttgtatatctgttcaagcatggtttgtaaacattttgatcaagtttgtatgcaaaatttcttgtatttagtgcatttatgtaaagattcatcctgtaaagaattataaactatgagacgctattgccatttatgatcatttatgtttatctttttagccttatgttatttgaatttgtctaatcaatgccatcttccatcacgagcacatcattgacatattactgatggatagacctttttgggacgtgagatgctaaaggcacaacctatatagctgaaaatttctaacatatttatcaataataccaagatgcctttgttgtttatcaattgcacattatttcaacgtaaatgcaattttgttaaatatgtcatggtgtcgagcctactgcttaccccagcatgttgaattgctgccttaagcagaaacatcgaaaaacctgcgtagattccacgatccaacaatcctctccgttcatttttttagttccatatgaaaggaccgattacgtctgaaagaagagtttcattagacaatctatttcttttaactaatgcctctagtttttcaaaacctatgcaataaataggtgtaactatagttttgactaagggttgtaatctctttgtaaaatatttatgcaatctcgatttcaaatctatccactagcctaacaactaataagataaaacatacaaccaagatacataatataaatacgggagcttaaatacgatatacatataaactcttattgatgactccattgtttttatcgagataccaagaaagacgcaagtttctccctagtcctcattggagcccagtccgcgcgagtaccaagctctcggtcaggtaacattgtggatagcctaggttttttgccacacacaagtgggtctttagtgtagcctcttctaaatgctctctatcaaaggtggtccaggaaaagattcaaaatggggccctagcagtagtagtattactactaacaacaataatgataaataagtaaatgctcaatgtgcataaaattgatctaagaagtacttgtaaactcatgtaatgttgtaaacttatttgcttatttctttatgtttcttttctcacatccgaacagattccttctagaggacatgattgtaagttaaaaaataaaatagaacactaattaaatcaaagctatcgctacttgctgagttacaaaattattaaatctatttataaaatactaccaattatgtcgtacttccaaattatcaaacaattgaatagattacaaaataatatttaatcaatagattacaaaatacctactacaaattcacaaaacaatttgtctagtttagtaattattcaaactatagttgtacatagtaattaatttggctttggtttagaccctcggccttggtgaacgacgaacaacgaggtatcctatgtgtagtcatgtatgatgcgtctaggatgtagatgcagtggccagtggcaatcctcagtcttcacgaatcaggatgaacatatggagggtggggcctcgcggaatagggggactagggta

SEQ ID NO: 8768 - DNA, 2798 bp, Vitis vinifera
ggagactgttccgaagaaagctcttctgagttctaccatttttacctctctgcaaattcgtagattcaatgaatagatttccaccgttcggttttcgcaaatctaatctgagcagaacaggctgccgtgcttacctttgattccggtttgtgtgaatttcgaaattctgtttgtatccgaatcctcaaagatccgatttccgtgtagtacagagattccgagctttttcgatctcgcgtcattttatgggtgatttagttctggctttggtctcctgttttattttttgaggctttacgctttggatgcgtcattgtttacgtgttcgttgatggtcatctaagtttcttccgaagcgataattgacattcgagcgaaggtcttgaaatccattttggtgagagatggttgcctttgggaaaaagctgaaagaaagacaaatccaggaatggcaagggtattacatcaactacaaattgatgaagaagaaagtaaaacaatatgttcaacaaattgaaggtggagcacaaaatcgccgtcatgttcttaaggacttctctagaatgctggatactcagattgaaaagattgtcctctttctgttggaacaacaagggctactagcaagcaggatagccaagcttggagaacaacatgatgctcttcagcagcagccagatatttctcaaatatctgaactacgagaagcttatagagcagtgggacgaaatctgttaaagcttcttttttttgttgagataaatgctattggtttgcgaaagatcctgaagaagtttgataaacgcttcggctatagattcactgattactatgttaaaacccgtgctaatcatccttattcccagttgcagcaagtgttcaagcatgtgggagtaggggctgttgtgggagccatatctcgcaatcttggagatcttcaggaccgtcaaggaagctacttatcaatttatgatcaacctgcccttcctctccaggatcctgtgattgattcaataaaagcagccgtagacaggttaacacactcaacaaacttccttcactttttggcccaacatgcacttattatgcaagaagagttacctactgctgttgaggagcatgtagacgatcaaagataccattttatgtcacttctgttaaacttggcaaatacatttctttatatggtcaatacgtatattgttgccccaaaagcggataactactccatgagccttggaactgcagcaaaagtttgtggtgttgtgattggggcaatggctgttgctcaagtgttctcttcagtgtattttagtgcttggtcaaataaatcatactacagacctcttatattcagcagtattgttctctttgtgggaaataccatgtatgcactggcttatgaccttgattcaatagtggttctcctacttggtcgtcttttctgtggattgggctctgctagagctgttaatcgacggtatatcagtgattgtgtaccactaaaaattcgcatgcaggcttctgcaggttttgttagtgccagtgctcttggaatggcatgtggtcctgctcttgctggattgcttcaaattaatttcaagatctacaagatcacatttaacgaagacactttgcctggttgggttatggctgtggcatggctggtttatttaatttggctatggatctcatttaaagagcctgttcgcgagacccaagagagcaatattcagcaggaatctaatgctgaaccagtagagaatgatgcacttgaaaagggtcttgctcaaccattgctcttaagttcagaagacaagcaagaagatgaagatggtgaccaagacaatgatgtgagtgaagaagctcctgaggagtctcgtgggccagccacttctattggttcagcatatagattacttactccctctgtaaaggttcaactattgatttatttcatgctcaaatatgcaatggagattttactctcagaatctagtgttgttaccacatattacttcaattggtccacgagcacagtggcaatctttcttgcatgtcttggcctaacagttcttccagtaaacattgctgttggaagctacataagcaacatgtttgaggataggcaaattttactggcatctgaaataatggttctcattggcatactcctaagcttcaacataataattccatactctgttccacaatatgtctgctcaggactcatcatgtttgtttctgctgaagtccttgaaggtgtcaatctggcactcctctctcgggttatgtcatcaaggctttctcgtggaacctacaatggtggactgctttcaactgaagctgggacaatcgctcgagtaattgcagatggcacaataaccttggttggttacttgggtgagagtaagctactgaatatcaccctacttccttcacttctcatctgcatatcctccatcattgctaccttctttacctacaactctctctattaattcatttctcttgcatcaaaagatgtagtgtctccaaatccattccatttccctcagtatttctctggtattctttgctatataatttttcttttcttttctgtttggtcctgtatgcatgctgtataatatgcgaaaactagctccttcattccccaattggattttcataattttttgagcctccagtgaagaggtcctctgtattgcaagttcagcaaccttttccattcttttgttgttgattcaaagtatatcatcaattactaatacatcctgccccttctagttgaattg

SEQ ID NO: 8769 - DNA, 1120 bp, Lactuca sativa
gcgggggctagcagcccccaaatcccctgttattcgagaaaaaacaaatcttccccttttgcgtctttgttgatgctcattgaagctgcccaattaagtgaaagatggttgctttcgggaagaagctgaaggatagacagattgaagaatggaatggatattacatcaattacaagctcatgaagaaaaaggtgaaacaatatgctcgccagattgaggcaggaggggtagaacgcagatatgtcctcaaagacttttcaagaatgctcgataaccagattgagaagattgttctttttctactggagcaacaagggctgcttgcaagcagattagaggcgcttgggttacaacaagatgctcttcaacaggaaccagattttgtaaagataaatgaattaagggaagcgtatagagaagttggaagagatttattgaaactattgttttttgttgagattaatgcagttgggttgcgtaaaattctcaagaaatttgataaacgtttcggttatagatttactgattactatgtaaaaactcgggcaaatcatccttattctcaacttcagcaagtctttaagcatgtgggtttaggtgcagtggtaggtgccatatctagaaatcttgcagagcttcaagatcgtcaagggagctatctatcaatttatgatcaacctgctcttcctctccaggaaccaataatcgacaccataatagcagcagtggacagattaagctactcaacaaatttcctgacatttttagggcaacatgctctgatcatgcaagaggaattaccaacacctttggaagaacacattgatgatgaaagataccatttcatgtcacttatgttgaacctagtcaacacctttctttatatggtcaacacttatatcattggtccaacagcagatgactaccccatgagcttaggagctgctgcaacggtttgtgggattgtgattggtgccatgggctgttgcacagttgttttcttctgtttatttcagtgcttggtcaaacagatcatatttcagaccattgatctttagcagcattgttcttttcatgggtaatgtcatgtatgcaatggcttatgatatgaactccatta

SEQ ID NO: 8770 - DNA, 2798 bp, Arabidopsis thaliana; identical to SEQ ID NO: 8745

SEQ ID NO: 8771 - protein, 335 aa, Arabidopsis thaliana; identical to SEQ ID NO: 8747

SEQ ID NO: 8772 - DNA, 1981 bp, Zea mays
ccagactagcagatagagaggcggagccgcggaggccagcatatctccctcgttttggtttgcgcccaagcaagcgcctcacgcgagcaccgccgctgccgccgttcactttccccctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagcttgctgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccagttcaattgttgtggctaattacatctgaaggttctctggctaattacatattttagttcctggcaagcgtcaatcaattaagttaactgcgctcacataacagaaattgacatagcagaagctgagcccatcgaagaagcaaacaaaatcagttgcattctatcattctccgcctgattcagatttggaagaatcgaacggatttaactaatttctttgttccttccgttctactacaagcttgaaatgacgaaactcatattgtatttacatatctactgattattgggttatttaccctatttactgattgttggtgtgttatttgcctgtaaaagtgaagtcaaatgttgtccagctgccctgaacctcttaagaccatctccaaagttcaacccccacctcatattcagtgtactatggcgacaacggctccaacagttccctatagtgctccttgtctagggctaaaaaaaagctcgaggctcgcgagccgactcggactccctcagactcagagaggctcatgagcctaaatgaatttgagccatccgagctgaaacagcgagctaagcctaaacaagtctgatccagtctaatgacacggtgctatattgttacattattacgttattatgttattgattttttttatagacgaaaaaaaaaaaaaaaaa

SEQ ID NO: 8773 - protein, 342 aa, Zea mays
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 8774 - DNA, 1525 bp, Glycine max
  misc_feature (1461)..(1461): n is a, c, g, or t
  misc_feature (1464)..(1464): n is a, c, g, or t
aagtttcgatcctaaaccttaaaccgattcacattattctttctcagactccttcactctgtgttgtcgtttctgtttcttcagcaattcttctcatcgtaggggaaaacatgaagttctgcaaaaagtatcaggaatacatgcaaggccaggagaagaaacttccatgtgtaggattcaagaagctcaagaagattctgaagaagtgcaggagaaactcttcatccctgaaaccccttaatgcatcccttgccgccaaaacctgccccgaccattgcccagtgtgcgatgggaccttcttcccttcccttctcaatgaaatgtcagatatagtggggtgctttaatcagcgggcgcagaaattgttggagctacatctcgcttctggggtcagaaagtacttcttctggatcaaaggcaaattacaagggaaccatactgcactgattcaagagggcaaagatcttgttacttatgcactcataaatgccattgcaattcgaaaaatactaaagaaatatgataagattcattattccaagcaagggcaattgttcaagtcacaagtccagagtatgcacaaggagattcttcaaagtccctggctttgtgagcttatggccttccacatcaatttaagggaaactaaggtcaagtcaaggaaggcacatgctttgttcgatggatgttctctcacattcaaggatgggaaaccgtcacttacttgtgagctctttgattctatcaaagttgacattgacttgacttgttctatatgcttggacacagtgtttgatccagtttctctgacttgtggccatatattctgctatatttgtgcatgctcggctgcatcggtatctattgtcaatggacttaagtctgcagatcctaaaatgaaatgtcctctatgtcgtgagggtgcagtttatgaaggtgctgtgcgcttggaagaactaaatattctgttaagccgaagttgtcaggaatactgggagcagaggcttcagacagagagggtggagagggttaagcaaataaaggaacactgggattcacagtgtagggcattcgtgggcgtctaagtacagcatgcaattttcttagtttcttttgtagtgtataaggtttgtagttttggctgaaatgtgaatatgcatctgtttaattgttgttgtgtatgtaacattttgaataaggcgaagccgcttttaaactctttggaagttttctagtgacaatgttattacttctttcctgatttacaaaaaaaaaaaaattctattttagactgtaatcaaaatgctttttccttttttcggtgtttcaaagtttcaatctttaccctttacagagtgcaatcaatcaacaggagatagaatagaatgatggagtcctggagcgagaaaaaaagactattctctctgtttgcctgctatgatggcatgcatgatatgttgntgntggtggtttaattctaataaacaattcgaaagcattttttttagtaaaggagatttttttt

SEQ ID NO: 8775 - protein, 324 aa, Glycine max
MKFCKKYQEYMQGQEKKLPCVGFKKLKKILKKCRRNSSSLKPLNASLAAKTCPDHCPVCDGTFFPSLLNEMSDIVGCFNQRAQKLLELHLASGVRKYFFWIKGKLQGNHTALIQEGKDLVTYALINAIAIRKILKKYDKIHYSKQGQLFKSQVQSMHKEILQSPWLCELMAFHINLRETKVKSRKAHALFDGCSLTFKDGKPSLTCELFDSIKVDIDLTCSICLDTVFDPVSLTCGHIFCYICACSAASVSIVNGLKSADPKMKCPLCREGAVYEGAVRLEELNILLSRSCQEYWEQRLQTERVERVKQIKEHWDSQCRAFVGV

SEQ ID NO: 8776 - DNA, 2347 bp, Oryza sativa
atgaagtttgccaagaagtacgagaagtacatgaaggggatggatgaggagctcccgggcgtggggctgaagcggctcaagaaattgctcaagaaatgccgctctgacctccaatcccacgagaacgacggctcctccgccggccgctgccccggccattgctctgtatgtgatgggagttttttcccatctcttctcaatgagatgtcagccgttattggctgcttcaatgaaaaggccaagaagcttctcgagttgcacctggcatcagtgactatttttgttagaattaacgtatctatcattgttcttgtctttggatttaagacggtcctcaatggttatattaataattatatacattactcgaagcaagggcaggaattcaaagctcaagcccagagtctgcatattgaaatacttcaatccccatggctctgtgagctgatggctttctacatgaacttgagaagaagcaagaagaacaacggtgctatggagctctttggggattgttctctcgtattcgatgatgacaaaccaacaatttcatgcaacctctttgactctatgcgtgtcgacattagcttgacatgttcgatttgcttggataccgtgtttgatccagttgctctttcctgtggtcacatatattgctacttgtgcagctgttctgctgcatccgttacgatcgttgatgggctgaagtctgccgagcgcaaatcaaagtgcccactgtgccgacaggcaggagtctttcctaatgctgtacacttggatgagctgaacatgctactaagctatagttgtccagagtactgggagaagagaatacagatggagcgggttgaacgtgttcgtctggctaaggaacactgggagtcacagtgcagggcattcttgggcatattcttagaaactggaccaaaggctagaatgtttgaggagattctgattccgagagaagctgctgcagttagaagctctcccaaacagccgcagggagatcacatagagcttcaccagaagcgccatggccggcgcctggactacgaggagcgcaagcgcaagcgggcggcgcgcgaggtgcacaagcgatccagggatgcccggcagttgcttggtgctaagggtaagaggttcgccaagaagcggtatgccgagaaggcacagatgaagaagaccctgaaaatgcacgacgagtcaacttctcggcagaaggttgatgatgttcaagagggtgctcttcctccatatctgctggaccgtgatcagacacaacgtgccaaggttctcagcaacacaattaagcaaaagaggatggaaaaggctggcaaatgggaggttcctttgccaaaggtcagacctgtggctgaagaagaaatgttcaaagttttacgaactggcaagagaaaaaccaaacagtggaagagaatggtcactaaggccacctttgttggacctgggtttacaaggaaaccaccaaagtatgaacggtttattaggccaactggccttcgtttcacaaaggcccatgttactcaccctgagctgaaatgtactttcaaccttgacataatttctgtgaagaaaaacccaaatggtcaaatgtactctactcttggtgttttgacaaggggaactatcattgaggtgaacgttagtgaacttggtctggtaacccctgctggaaaagttgtttggggtaaatatgcacaagttacaaacaacccagagaatgatggctgtatcaatgctgtcttactcgtgtaaggacgcaatgctatacacttcattcttctcgttgcgactctcaccccagatgtacccgttcagtgggtctttttgaccgatcattcagagtagcgtgttttaaactgtgggcacaaggctcatctgttatatgcctttaacatatctggaatacattttacattgtatgtcgtggtgcagaaaagatctttactagttacattttacaacctgttatgagagctacaagtctggtctcatttgcttctaaacttctgcatgtatgtactaacagtgtatctgctagtacttcccccgttccaaaattatctagcatttgaaatataaacacttctagagtgtttatattacatctaacgattatcccatattatctatcaaccattacccattaaaaacaaagaaaaggggcgcggtctaaggatcagatacgataggtaatggagtatactctatatgggtccaatatatcgggcggggtttaaagtgtgagtggacctgggttcagtaggcggagaatcctgagtggtataaaggcgactcaaagaaagaggagagggacggggatgagaac

SEQ ID NO: 8777 - protein, 321 aa, Oryza sativa
MKFAKKYEKYMKGMDEELPGVGLKRLKKLLKKCRSDLQSHENDGSSAGRCPGHCSVCDGSFFPSLLNEMSAVIGCFNEKAKKLLELHLASGFKKYTMWFTSKGHKSHGALIQQGKDLVTYAIINAVAMRKILKKYDKIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYSCPEYWEKRIQMERVERVRLAKEHWESQCRAFLGM

SEQ ID NO: 8778 - DNA, 2700 bp, Arabidopsis thaliana
aatgattgggtccgagagtaaatgcgattgagaaatgatcacattactcgcgataagagtctgcgatctactataagcaaactagtcgtcttttgattctctccttcttcacctttttatcaatttcctcgcttacaagattcaaagggcttattacgttgatggtcatctaaatctcaagaagacaaagttgcgatttttgcaattgggtttctctcttcagagatttaatctgtataagaagatctcaagatcagcttttgtgtattgaagaagaactaggaagaacgaggatagatacaggctttaatctaaactttgctctctgctttctgcgattaaaagatggtggcttttgggaaatacttgcagcggaaacaaatcgaagaatggagtggctattatatcaattacaaattgatgaagaagaaagtgaagcaatatgctgaacaaatccaaggcggatctcaacatcctcgccatgttctcaaagatttctcgaggatgctcgatactcagattgagacaactgtccttttcatgttggaacaacaagggttgctttcagggcgattagccaaattgagggaatctcatgatgctatacttgagcagcctgacatatcaagaattttcgagctacgtgaagcatacagagatgttggacgagaccttcttcagctcctgaaattcgttgagttgaacgccattggtctgcgcaagatacttaagaaattcgacaaaaggtttggatatagattcgctgattattacgtgaagacccgcgctaatcacccttactctcagcttcaacaagtttttaagcatgtgggtgttggagctgttgttggagcaatttcccgcaatcttcatgagcttcaagaaaatgaaggaagcttttattcaatttatgaccaacccgttcttccggctcaggatccagtggttgaggcaataaataacgcggtggacaagttaaccttctcgacgaatttcctcaacttcttggcacaacatgctcttatcatgcaagatgatttggtgactccttcagaggatacaatcgatgagcggtcttaccattttaattcgttactcctgaatctaggaaacacatttttgtacatggtcaacacttatatcatcgtccctacagcggatgactattcgatgagccttggagctgcagcaacggtttgtggtgttgtcatcggatctatggctgtggctcaagtattttcatcggtttatttcagcgcatggtccaacaaatcttacttcaaacctcttgtgtttagcagcatcgcactctttatcggaaatttgatgtatgcgttggcatatgatgccaattccatagcgcttcttttactcggccgtgtctgttgtgggttgggatcagcaagagctgttaaccggagatatatcagcgattgtgtgcctttgagaatccgaatgcaggcatcggcgggttttgtgagtgcaagtgctcttggaatggcttgtggccctgcgcttgccggtttactccaaatcaaattcaagttttacaagtttacatttaaccaatctactttgccgggatgggttatggctgtggcttggctgttctatttggtatggctatgcatttcattcagagagccgttgcgtgacacagaggatggagaaaaaaacaatcgaaatgaaacaacatcagcgacagatagagtagaaagtagcagagtcgaggaaggtcttcgattgccgttgctgatcacttcaggaatcaagccagaagatgaagaggaatgcgatgaaagtgaagaatccccagaagattctcacaaacctgcaaattctttcatagaagcataccgactccttactccatctgttaaggttcaactgttgatctacttcatgctcaaatattcgatggaaatattactgtcagaatcaagtgtcattacttcatactactttagttggacaacaagctctgttgccatcttcctggcctgccttggcctcacggtgctaccaatcaacattttggtcggaagttacatcagtaatatgtttgaagacaggcaaatccttctaacatctgagatcatcgtcttccttgggattctcttcagtttcaatttgtttgttccatacactgtacctcaatacgtaatctctggtctcataatgtttgttgctgctgaagtactcgaaggtgtgaatctatcgttgttatcgcgggtaatgtcatcaaggctatcgaaaggaacgtacaacggaggattgctctcaacagaagctggaacgttggctcgtgttgtggcagatgcaaccataacattgggaggatatttgggaagaggccatctcctgaatgccactcttctaccatcacttgtcatctgcattggctccatcgttgctacttgttgtacttataactcactctattgattttggagttttgctaccaaattttacaaaatagaataaaacagtgtgtatgatcgatcctctctttgatttgattatttttgttgttctaattcatatgggtgtatatgtgttttataatacatatagtatgtatattcgtatatatacggtgaatatcaaatcctccatttgttggaaattccagttttgtgagattctttttctgaagtattgtaataaattctcatataaatttataagtttttatttggt

SEQ ID NO: 8779 - protein, 699 aa, Arabidopsis thaliana
MVAFGKYLQRKQIEEWSGYYINYKLMKKKVKQYAEQIQGGSQHPRHVLKDFSRMLDTQIETTVLFMLEQQGLLSGRLAKLRESHDAILEQPDISRIFELREAYRDVGRDLLQLLKFVELNAIGLRKILKKFDKRFGYRFADYYVKTRANHPYSQLQQVFKHVGVGAVVGAISRNLHELQENEGSFYSIYDQPVLPAQDPVVEAINNAVDKLTFSTNFLNFLAQHALIMQDDLVTPSEDTIDERSYHFNSLLLNLGNTFLYMVNTYIIVPTADDYSMSLGAAATVCGVVIGSMAVAQVFSSVYFSAWSNKSYFKPLVFSSIALFIGNLMYALAYDANSIALLLLGRVCCGLGSARAVNRRYISDCVPLRIRMQASAGFVSASALGMACGPALAGLLQIKFKFYKFTFNQSTLPGWVMAVAWLFYLVWLCISFREPLRDTEDGEKNNRNETTSATDRVESSRVEEGLRLPLLITSGIKPEDEEECDESEESPEDSHKPANSFIEAYRLLTPSVKVQLLIYFMLKYSMEILLSESSVITSYYFSWTTSSVAIFLACLGLTVLPINILVGSYISNMFEDRQILLTSEIIVFLGILFSFNLFVPYTVPQYVISGLIMFVAAEVLEGVNLSLLSRVMSSRLSKGTYNGGLLSTEAGTLARVVADATITLGGYLGRGHLLNATLLPSLVICIGSIVATCCTYNSLY

SEQ ID NO: 8780 - DNA, 1111 bp, Arabidopsis thaliana
atgaagttcggcaagagcctaagcaaccagatcgaagaaactttacctgaatggcgcgacaaattcctctcatacaaagaactcaagaagaagctcaagcttatggagccacgaagcgtcgagaatcgtccaaataaacgttcgagatccgattccaattctgtcgacacagatccaacggttggtatgaccaaggaagagcttgatttcattagtcttcttgaagatgagcttgagaaattcaattccttcttcgttgagcaagaggaagagtatatcattagattgaaggaattgaaggaccaagtggcgaaagcgaagaattctaatgaagagatgataaatataaagaaagagattgttgattttcatggagaaatggttttgttgatgaattatagtgctcttaactatacaggattggcaaagattctcaaaaagtatgacaaaagaaccggtgctttaatccgtttaccatttatccaaaaggttttgcaagaacctttcttcacaactgacctactcaacacatttgtgaaagagtgcgaggctatgctggaccgcctctttccgtctaacaaaagtcggaatctggatgaagaaggagagccgacaacttctggaatggtcaagacaggaacggacgattctgaacttcttagagtaccaaaagaactgtctgagattgagtacatggagagcttgtatatgaagagcactgtgtcggcattaaaagtattaaaggaaatccgcagtggtagctcaacagttagcgtcttctcgttgccaccgttaccggcaagtggattagaagatgattcatggaagaagaaagttggtgtccttgaacaagtagcgaaatgaattatgagtattattatttttaaatctctctttttttttgtactttctttaaatagtacaagtaattgtatacgcttacagctgtaaaagatgaatcaaataaaacatagaagtgtgatcatctttcaacatttaaacttggttgcgtgtactttttcttttgctgcatatcatgtatgaaaaatcttctgtaagactgtaacaccactttcaagcagagagaacaatgaaatacatacgccatttc

SEQ ID NO: 8781 - protein, 287 aa, Arabidopsis thaliana
MKFGKSLSNQIEETLPEWRDKFLSYKELKKKLKLMEPRSVENRPNKRSRSDSNSVDTDPTVGMTKEELDFISLLEDELEKFNSFFVEQEEEYIIRLKELKDQVAKAKNSNEEMINIKKEIVDFHGEMVLLMNYSALNYTGLAKILKKYDKRTGALIRLPFIQKVLQEPFFTTDLLNTFVKECEAMLDRLFPSNKSRNLDEEGEPTTSGMVKTGTDDSELLRVPKELSEIEYMESLYMKSTVSALKVLKEIRSGSSTVSVFSLPPLPASGLEDDSWKKKVGVLEQVAK

SEQ ID NO: 8782 - DNA, 1086 bp, Arabidopsis thaliana
ctctctttcttcttcattcatcattctcacttaagtttcccagaaaataaaagagctatgaagtttggtaagagtctcagcaatcagatcgagcaaactcttcctgaatggcaagacaagttcttgtcttacaaagaactcaaaaaacgactcaaactcatcggttccaaaaccgccgatcgtcccgttaaacgactccgtttagatgagttttccgtcggaatatcgaaagaagagatcaatttcatccaattgttagaagacgagttggagaaattcaacaatttcttcgttgagaaggaagaagaatatatcatcagactaaaggaatttagagatagaattgcgaaagctaaggattcaatggagaagatgataaaaatcaggaaggagattgttgatttccatggagaaatggttcttcttgagaattacagtgctcttaattacactggattggttaagatactgaagaagtatgacaaaagaactggtgatctcatgcgtttacctttcatccagaaagttcttcagcaacctttttacactactgacttattgttcaagcttgtcaaggaatctgaggcaatgcttgatcagatcttccctgctaacgaaactgagtctgagattatccaagcagagttatcagagcataagttcatggagagtcttcatatgaagagcacaatcgctgccttgcgggttttgaaggagatcaggagtggaagttctactgttagtgtgttttcattgccgcctctacagttaaatggcttagatgagacatggaagaagattccattgttggagcaagaagccaaatagagagtgagacagaggcacactcgctctattccacttttttatacaatagaagaagctaacagattaaacaagacattatcatcaatgtacacaaaaaggcagaagaaactataggatcatgtttctggatatcatctttggtcggtcataagtccttaggttacacaaaactgcaatgtaactttgtttctgtgttgggtgtgttgtagttgatgtaatatataccacttcagattaattattgatttcttcttttcc

SEQ ID NO: 8783 - protein, 256 aa, Arabidopsis thaliana
MKFGKSLSNQIEQTLPEWQDKFLSYKELKKRLKLIGSKTADRPVKRLRLDEFSVGISKEEINFIQLLEDELEKFNNFFVEKEEEYIIRLKEFRDRIAKAKDSMEKMIKIRKEIVDFHGEMVLLENYSALNYTGLVKILKKYDKRTGDLMRLPFIQKVLQQPFYTTDLLFKLVKESEAMLDQIFPANETESEIIQAELSEHKFMESLHMKSTIAALRVLKEIRSGSSTVSVFSLPPLQLNGLDETWKKIPLLEQEAK

SEQ ID NO: 8784 - DNA, 2837 bp, Oryza sativa
gggggatggcgaggcgtttttggccacgcaaacgccaaaacggaaccgtcccggtcgagatccccccctccacgtcggcctccgcgcgcgatacgaccgacggccaggcctccacacacgcatacctatggctgtcccggccacagccccggcgaggaggccccctcctccatgtcttctctctcccgcagtcgccgctataaatattgccccccggccctctcctcctcatctcccctgagcggagcccagcacacacacagacagtgtcgacattagccgttgcagcactcgggcgcgtcctctgaattgcgacgggatcccctcctggaaccggaggagagaaacggattcccgcgataattctggcctcagcgcttggtacgattcggtggatttgttgatggtcatctaacaggaggagagatcgtttcgccgggaggaggacgaaatcagggaatcaccgaagaacgcgcgtttcaggttccctcagtaaaacgccaagatggttaatttcgggaagagactgatggcggaccaattggaggagtggaaagagtactacatcaattacaaaatgatgaagaaaaaggtaaaacagtatgttcagcagacgcagaatggtggaagaaatcgtgaacaggttcttaaagagttctcaaggatgcttgatgatcagattgagaagattgtgctctttcttctgcaacaacaaggccatcttgctagcagaatcgagaaattgggagaagagcgtgcattgctcatggaacaagcagatgcatcccaaatttctgagctacgagaggcatatagggaggttggaattgatcttatgaagctccttagatttgttgatatgaatgctaccggcatccgaaaaatactcaagaaattcgataagcgttttggctacaaattcacggactattacgtctccactcgtgcaaaccatccctgttcccagcttcagcagatcttcaagcaagtgggtattgtggctgtagttggtgctttgtcgcgcaaccttgcatttctccaagatcatcaaggaaactttccatccatctatgatcatccatcaattaccttaaaggaccctatcatagaacaaataaatcattcggtgcagaaactcacacacgcaacaaacttactgcaattcatagggcaacatgcacttatcattccagaagatatgcatagtggctcagaagatcttgtcgatgaccagagctaccatttcatgtcgctgcttctgaacctagctaacacatttctttacatggtgaacacatacatcatcgtgccgactgcagatgactactcagtcagcctcggagcagcagctaccgtttgcggcgtgatcatcggatcgatggctgttgctcaagtgttctcttcagtttacttcagtgcctggtcaaataagtcatatttcaggcccctcgtgttcagcagcattatgctgtttttgggtaacctgctgtatgctttggcatatgatgtgaattccttaactgttcttatagttggccggctgctctgcgggttgggttctgccagagcagtgaaccgcaggtacatcagcgactgtgtgcctctcaaaaccaggctgcaggcatctgcaggatttgttagtgctagtgctcttggaatggcctgtggtcctgctcttgccgagccagaccacattgttagagagaattcagtcaacacaccgtcatctgattcaggccatcgaagaaatagtaatttggaagatggtctagcacagccttttctcatagatgcaaaggagagtctggatgaaaatggagaggataatgacgaaaatgaagaagaccctgaagactcacataaaccagcaacatcacttgctgcagcatacagattgctgacaccatctgtgaaagttcagctattgatctactttatgctcaagtttgcaatggaaattctactgtccgagtcgagcgtggtcactacgttctacttcaactggtctacaagcaccgtggccatgtttctagcagttcttgggttgacagttcttcctgtaaatgtcatcgttgggagctatgtcaccaacttgttccaagacaggcaaattttagtggcatcggaaatcatggtcctgatcggcatagccatgagcttccgtttcacctctcactactccgtcccgcaatacgtctcctcggctctcatcacgttcgtcttcgctgaggtgctcgaaggagtgaacctgtccctcctttcccgggtgatgtcgtcgaggctctcgcgcggaacctacaacggcgggctcctctcgacggaagccggcactttggctcgcgtcgcggcggacatgacgatcacggcggcgggttaccttggccagaacagcctcctgaatgtaaccctgcttccgtccttcgtgatctgcgtagcttccatcgtcgcgacattttgcacctataactccctgtactgagaatctgttctctccgtctgtatgtacaagaagcagttgacacagttcctggccacttgggtggcctgtaaaatgttaggccgatgcagctaatgctggtctctaattgtcatctgtggaagattaggttatgtttgtagtagcagttactaagttaacagatgatgtaagagcatgttcaataaactctactgatcaaatgctccaaaagcctcttggacaatcctgcttgcaccggaccagcgagttccagggcaacggcaagagcataaaaaaaatgtaggctcagcggccaagcaaaggttaattggtgcggatcagagtgaagtgaggtgatcaccggtggtttttgccgttt

SEQ ID NO: 8785 - protein, 657 aa, Oryza sativa
MVNFGKRLMADQLEEWKEYYINYKMMKKKVKQYVQQTQNGGRNREQVLKEFSRMLDDQIEKIVLFLLQQQGHLASRIEKLGEERALLMEQADASQISELREAYREVGIDLMKLLRFVDMNATGIRKILKKFDKRFGYKFTDYYVSTRANHPCSQLQQIFKQVGIVAVVGALSRNLAFLQDHQGNFPSIYDHPSITLKDPIIEQINHSVQKLTHATNLLQFIGQHALIIPEDMHSGSEDLVDDQSYHFMSLLLNLANTFLYMVNTYIIVPTADDYSVSLGAAATVCGVIIGSMAVAQVFSSVYFSAWSNKSYFRPLVFSSIMLFLGNLLYALAYDVNSLTVLIVGRLLCGLGSARAVNRRYISDCVPLKTRLQASAGFVSASALGMACGPALAEPDHIVRENSVNTPSSDSGHRRNSNLEDGLAQPFLIDAKESLDENGEDNDENEEDPEDSHKPATSLAAAYRLLTPSVKVQLLIYFMLKFAMEILLSESSVVTTFYFNWSTSTVAMFLAVLGLTVLPVNVIVGSYVTNLFQDRQILVASEIMVLIGIAMSFRFTSHYSVPQYVSSALITFVFAEVLEGVNLSLLSRVMSSRLSRGTYNGGLLSTEAGTLARVAADMTITAAGYLGQNSLLNVTLLPSFVICVASIVATFCTYNSLY

SEQ ID NO: 8786 - DNA, 2847 bp, Oryza sativa
acccctccctcagcttcccttcccatctgcccgtcttcttcttcttcctcctcctcctgccctacccgcggccgcgcgatataaatacatcaccctccccatccgcctctccgccagcaaaccagcacagccgtacgccgccggcaactgcgttcgcgcgagcgcctgtccgcgttgtacatatttgtgagtaatccgtcacctctgtacgcagcacgcacatgccgccgccaaagcgcagatgattccagtctttccctacttttgaatctgtgcctgatgaatctgcgtcgtcgtgctgtagcactagcgagtgtttcccttgcgacgtagagtttgctgatgttcatctaattagcccggaggactcgggaatcagaattcaccgtggtgtcagggagaaaaagtggatcgaacttcggatcacctggtaccatttgtttacgatacaggtattgaacgacaagatggttaattttggaaagaagttgatggctgatcaagtagaagaatggaaaggatactatattaactacaaattgatgaagaaaatgttgaagcaatacgttcagcagacccaacttggtggaaaagatcgagagcaagtacttaaagagttctcaagaattcttgatgaacagattgaaaggattgtactttttctgctacaacaacaaggccaccttgctaataggattgaggaattgggagaacagcgtgctgctcttctagaacagcatgatatatcccaagtttttcaactacgagaggcttatagagaagttgggcgagatcttataaagcttctccgttttgttgatatgaatgctactggtataaggaagattctaaagaaattcgataagcgctttggctataggtttacagactattatgtcaccactcgtgcaaaccatccttattctcagcttcaacaagtctttaagcaagtggggattgtagctgttgtaggagctttatcgcgcaaccttgcatatctgcaagatcatgaaggaagtgttttgtccatctatgatcatccatcagttaccttaaaggaccctatcatagaccaagtaaatcatgcggtacaaaaacttacacatgcgacgagttttctgcaattcttaggtcaacatgcacttatcatccaagaggacgtgcaaagtgggtcggaggatcttgtcgatgatcaaagttaccatttcatgtctttgatactcaacctagtgaacacctttctttacatggtgaacacatatatcattgtgccaactgctgatgactacgctgtaagccttggagctgcagcgacagtttgtggcgtaatcatcggatcaatggcagttgctcaagtgttctcctcagtttatttcagtgcatggtcaaataggtcatacttcagacctcttgtattcagtagcatcatgttattcgctgggaatctgctatatgcattagcatatgacctgaattctctgacagttctcctgattggccggctactatgcgggttaggctctgcaagagctgtgaaccgtcgatatatcagcgattgtgtgcctctcaaaatcaggctacaggcctctgcaggattcgtcagtgctagtgctcttggcatggcatgtggccctgctcttgctggtttactccagacaagatttaagatatactcactcacttttgatcagagcacgttgcctgggtgggtcatgtgcattgcttggcttgtttacttgctgtggctgtggatatcattcaaagagccgggacactttgctaagagttcagacacggcacagcctgctgaatctggccatcaagtcaatgctaatctggaggaaggtctagcgcaaccattgcttacaggctcagaagagggacaagaccaaaatgctgaggataatgacgataacgaagaggagtctaaaaattctcacgggccagcaacttcaatcagttcagcatacaaattgttgacaccatctgtgaaggtccagctattgatatactttatgctcaagtacgctatggaaatcttgctctctgaatcaagtgtcatcaccacatactattttaactggtctacaagcgctgtggctatctttttagcgattcttgggtgtactgttctccctgtcaacgccattgttggaagctacattacaaatttattcgaggacaggcaaattttggtggcatctgaaatcatggtcctcattggtataatcatgagcttccgttacacccctcactactccgttccgcagtacgtcttgtccgctctcatcacatttgtgtttgctgaggtcctcgaaggagtgaacctgtcgttgctttcacgagtaatgtcgtcgaggctcgcgcgaggaacctacaacggcggcctcctgtcgacagaggccgggacgctggcccgtgtagttgcagacgcgacgattaccgcggcgggttatctaggcccggacctcctgctcaacatcactctgctgccacctcttgtcatctgcatagcctccctcgttgcaacattctgcacatacaacaccctgtactaaggaagttgcctctctctgcacactgtagagccggttaaactttattcatgctcacattgggttgtattttacatgtatctgcatgcggtagcattctttgtttgtacaagtccttaaacagttcaataaaatgttcttctgtaaatcctacagatgttttctcgatgcatgtttacagtccttatgcattttacatatgtattcatttttcctatatctgtaaaaaaaatttcttgatctgtaccaatattatgagttatgaggttgaaaagacacatgcaccatggac

SEQ ID NO: 8787 - protein, 696 aa, Oryza sativa
MVNFGKKLMADQVEEWKGYYINYKLMKKMLKQYVQQTQLGGKDREQVLKEFSRILDEQIERIVLFLLQQQGHLANRIEELGEQRAALLEQHDISQVFQLREAYREVGRDLIKLLRFVDMNATGIRKILKKFDKRFGYRFTDYYVTTRANHPYSQLQQVFKQVGIVAVVGALSRNLAYLQDHEGSVLSIYDHPSVTLKDPIIDQVNHAVQKLTHATSFLQFLGQHALIIQEDVQSGSEDLVDDQSYHFMSLILNLVNTFLYMVNTYIIVPTADDYAVSLGAAATVCGVIIGSMAVAQVFSSVYFSAWSNRSYFRPLVFSSIMLFAGNLLYALAYDLNSLTVLLIGRLLCGLGSARAVNRRYISDCVPLKIRLQASAGFVSASALGMACGPALAGLLQTRFKIYSLTFDQSTLPGWVMCIAWLVYLLWLWISFKEPGHFAKSSDTAQPAESGHQVNANLEEGLAQPLLTGSEEGQDQNAEDNDDNEEESKNSHGPATSISSAYKLLTPSVKVQLLIYFMLKYAMEILLSESSVITTYYFNWSTSAVAIFLAILGCTVLPVNAIVGSYITNLFEDRQILVASEIMVLIGIIMSFRYTPHYSVPQYVLSALITFVFAEVLEGVNLSLLSRVMSSRLARGTYNGGLLSTEAGTLARVVADATITAAGYLGPDLLLNITLLPPLVICIASLVATFCTYNTLY

SEQ ID NO: 8788 - DNA, 10604 bp, Zea mays
ctgcgcgcgttagtttagcgctactgttttctttttaaaattgacggtttcatttttcaaaacacgcacgacaacaaaaaaaaacccgtgatctcggctgaattaatagtgtactctcttatttcttgctgcggtagattaaagggcgtttgaatgcactagaactaattgttagctgctaaaattagttaagacatccaaacaatctagctaatagtttagctattagctacttttagcaaattaggtaatagttagctagctaattccactagttatttttagtcaacaaactattatctctaatgcattcaaacatcacctaagagcatctccaacaacgtgacctataaaaatgctctataatttgaaaataagtatattttatagaatttagggcgccaacaaaacatcccgcttcaacagtaaagccccaaatctagattatagggcagctcactacggtgtagtatatttgagtcacttgagagagtgccttatagttttttgacaaaattttatgaaatggagcactgttggagtagtttttcctgtgtagagccctatatttcaatttaaggcactagtttgaggcattgttggagatgctcttacaaatacacggaacatatttgggttcagcaacagggacggacggacggcgcgccgtgttctacagacttgccgtcgctgcttctgcatctgttcgaaaaccgtaacccccgtgcaccgctggtcagtagtcgtcgtttcgtttcgtttcgtttcgtcgcggcgatcttcgaaccgatgaagcgtggcacttggctggttggtggtggtacgccgggccagaaggtgacctgcctcgatccgaataccatgcatcgatctgtgcacgtgcctgttctcttcctactccgattaccgatagtccgggccgggaaaaagagcgcgaagccagatctgaccactaggggtctgtttggttggtttctctcgccaacctggctgtgtgagccaggatcactggagcctggctctgaagatacgaccaatttgctcgtatctggtgagcctggcccaaggtgctttaaggatcgtgcgagtctggattcaaatctacatgcagacaaccaaacacagagctcgcacgcgcatagcttggctcatagcaaccaaacagcagctacccgcatcccgcgacgcaagcacgcgcagatgcaggcaaccaaacagaccccaggtgatccaggtcgtcgaatgttccacgcgaaccgcagccgcgagtgccgtctccggctccgccacaggtagagctcagagcagaaaatgctccagccacctgtctctcttcttcctccttcctgccctgcacgcggctataagtacccaccgccatctcactttgcccagcagcacggcagtagctgcgccattgcacgcctccggccggcggctgcttgtcttgctgcttctgccgcacatccgtgatccgtacgtcgtcacctcaccactcacgcacaagcacaaagagcgttaatttcttgctggagattctattctatttctatggcgtgtccctgatcgaatcctaaatcctaaacctctgtggtgcactgcagggcagaaggtgcttcgttcgttgcaggcctggcgccacgccgtaccgtgcaagcgcgtttgctgatgttcatctaattactgtataataatatctccgggcgaaagagctagcaatcgtcggcgggggaggaggggctcgattgctgctcaaggtgagttgtaattccttggctctggatttccctatctgttggctgttcatggatcatccaatggatggatggcgctccctgttctctacacctgcgtgctcttttccctcgcctcgccggggtcttgtgtcagttactrtatctccctgttgattttaaaatctaagaagcaacaacaaaagatgattcaaaaaaatattcaaatttgaaggaccasaatgcgtgtgctactgctagctatgctaccattagagcatgccttcactgcattcttcttcttttgttacgagtgcttaatctcatggctcgctcccttaattcttgctaccattagagcatcttcaatactttctaaaaaaaaccacttgacaaactaatgaaatcagttggtaaactaataagtttcacgagtgactaaaaaaaagataggagctagcttctagtcctagataatgctcttatgagctttccttgtccagttgtcccaactcccaacgaacaaaaaaaaaaaggtaagaaaacacatttggcctttcttcttttttcttttcaactcaaaacgatcgctcagttacaaaaaaaaaagagagcttgcaattgcgagcgagataccaccgttacagggaaaaaaaagacaagttgttcaagttctctactagcttcctagcgcttccgtgtcgttctagatgagcttctctagcaaaggacaataatttggttgccacgtcagatgtcgactcagtgtcatttgctaccagctggcttatcaacttgggagattattgctcgcacctggacccggtgtccagtcaattattaatgatgttgatccatcttcgtatttttatcttggcaagaaactgttagtattaagttactgtcacctttggaagctgaatctcccctcgaagatatcagtatgggcatatagccatccgttcttatacacagctatttacgtctattttacaattttatatcttcgtcttcctcttttacacctacattcgaaccatctatttagagctttcaatgtgcaattcgtctttggtcattgtcaacatgaaccgtccagtgataatgctttgatgctgactaagaagtacggtctccgttcttaaatatttattgtctaatatttatttttaaaataaaacatgataaataaaaaagaacggagtgagtagaatacattgtgagctgttgttggtttgttgcacattctttacttgtttttttttacgaacatttgttgcaagcatcagcaaagccgtataaacttgtgcagctctagatagcgatttttttaaacaaaaccttaatattagattttggagcattgatttagaaagctgagcaactccaatgggagaggtgtttattttctcgtccatccacatccgccgttggcccgttgtttcttttctacccgcgcctgtggggcccaaccgtccggtcaaccgaccagcgtttcctgttccaccgtacgtcgtcgttctcgttcggtcgttttcgttcccctacctccagtccagtcccaggtccgagccggaccttgatcgccgccgtgcctcggcgcaaggaatggggccttcggtcttacccttgcacgcgccgccggcatcaggagacgtctctgtgtgcttcgccgtgccttcagccgtagccggcgccgcatcagcgtgctccagagaggaccgcagcttccagcacgtgtccctgacaccgccccacactggattgggaagggccgctgaccccacgcacctgcccgctggccaggttggaaggtttgggaaatgagatgttgattttaagctgacttttgagggttttagcttacagctttttaaatcaatcttcgaccaacggtttgaaattccgtgtttagagttgaattactcgattcagaagtttaagtttctctaatttaagctaaagggagaagagatggagcgcctggcttgagttggccgcacgcagctgggaagaaggatctgaaaacactgtcgtccatgtattgattcacttaaacatttgtccgtatctattattttaatttttttataatctacggtcacaagatatgcctgtgttgtttgtgaatagaaaacactgaacaatgattgtgagtcaacagctatcattatttgtgttttggttatgcgagggtatactaatgtctaatgattggctaaaccttagtcttacatcgctgtctttccttgcgctgtagggcaaggcaaccaccaattgggtaaaagcatataagcaggcttaccgatcaataaatataaaaaagggtagctttcaagaagtctgcttatgtaataccattattttccttctttttttacctcgaaggagtgataatcaccaaaatagcattatattgtcatcatacggctgcactatctttttcttctgtaacatgccgtctaattattatcttcagtttcagactcagttatttgaaacatcaagatggttaatttcggaaagaaattgatggctgatcaagtggacgaatggaaagggtatgacttttcttttggtacttatgaaatcatctatttttatcttatcagggcaaatgttctttattttcatatatgcccactccactagtccactaggatacattaatgcaccatataactgtagatcaccatatcacaatccttactatggtcatctggttaattttctaattaaactaaacaacttctagcacttatcaaattgatacgttgcgctacaacgatgaagtcagtccccgctaatgcaagctagtgtcattttgtttaacagcttatcagaaatcttatcagccttttggtctttccattgctagatactacatcaattacaagctgatgaagaaaatgttaaagcaatatgtccaacagacccagcatggtgggaaagatcgtgaacaagttcttaaagagttttcaaggattcttgatgaccaggtatacaaagaagcctttcccttgaaatgatcataatataagattttgagcatcatgtctattctgtcagtagtcacttgtatccttgtaaggaacagaacagtgtcatgcgacaagcttaatagtcttagtgaattgggatcatttttcttagttgtgagctaaaatacacatgtatttcttcgttccagattgaaaggattgtgctttttctgctacaacaacaaggccatcttgccagtaggattgagaaattggcagaaaaacgcactgctcttctggaagagtatgacatatcacaagtttatcagctgcatgatgcatacagggaagtcgggcttgatctcataaagcttctccgctttgttgatgtgaatgctactggtatacgcaagatactaaagaaatttgataaacgctttggctacaagttcactgattattatgtcaccactcgtgcaaatcatccttattctcagcttcagcaagtatttaagcaagtggtaattttcatgcattttgcattttcctttcttgatgtgtgaagtaattcccagtacctattatttatcatggactcatacggatgcagggaattgtagctgttgtaggtgcattatcgcgcaaccttgaatatctgcagcatcatgaaggaagctttgtatccatctatgatcgtccagcagttaccttgaaggtattctattttcactattccattctcatttcagaaattctgctattgaatttataaatgaaaaccttgaaaggtgctctttcttacctcggaactgcatcaattatatttccacatgaagtagggtgtgacatgacacttttttgttgttatattcaggaccctattatagaccaagtaaaccatgcagtacagaaactcacgcatgccacgaattttatgcaattcttgggacagcacgcgcttattgtccaggaagatgcagaaagcgagtcggaggatcttgttggtgatcagagctaccatttcatgtccctggtgcttaatctagtgaacacattcctttacatggtgaatacatatatcattgtgccgactgcagatgactatgcagtaagccttggggctgctgcaactgtatgtggtataattattggatcgatggcagtcgcccaagtattctcctcagtctacttcagtgcctggtcaaataagtcctacttcaaacctcttgtgttcagtagcattatgctgtttcttggaaacctactgtatgcattggcatatgatctgaattcactaatagttctcctgactggacgactgctatgtgggtatgcaattttctcaattcactctatctcacttgatttacgttccacttttgtatgctagcattgatctgggtgaaaattactagtatgacaaatgcaggttgaggatccttaagctgagggcaatattctagaatatttatattgctgaatagaaaacaaaatggaaactgtatatcttacaaggagataaaggattttaaatctcgagactggcattaaaatatatgcttttctatttcttttatagaacttaactagttatccctacctccctttgggctagtaatttgtctatattgtttaaggttcttgattttctgacggtgcatctgtgatcgagctgccagcatgtaatgtgcaggttaggctctgcaagagcagtgaaccgtcgctatatcagtgactgtgtgcctctcaagatgaggctacaagcctctgccgggttcgttagtgctagcgctcttggcatggcatgtggccctgctcttgctggttttctccagattaaattcaagatatactcgctcagttttaatcagagcacattgcctggatgggtcatgtgcatttcttggcttatttacttattgtggttgtggcttacattcaaggaaccagaacacttcactaaaactctggtcaatgaacagccgtcagaatctggtaagctaacaatacactgaaatggcaacatgttttgtttgaattcatgaatatgctcgaatcaaaccttattgtacaatcaggatgtgtatgcttatcattcttaggaacttttctgagatgtttatttccttattatgaaaataggccgccaaggaaattctaacttggaggcaggtctagctgaaccattgcttcaargtatagaacgaaggcaggatgagaactcagaagttaatgatgatactgaagtagagtcagaaagctctcatgaaccagcaacatcaattgcttcagcatacagattgctaactccatctgtgaaggtttccttccccctcccttcccaattatcgatttttctttgtcttgttcttggttcaaacgtttgaaagaaagaagctcacaatctacatagggttcttttgtaaataaagttagataaattaactatataatataataaaactgcatctttaaatagtaatgggtaaatacattccagttactagtaggtacatctgcatgtcatayaagcaaacataacggacacgccatgtaaaagaaactaggccaacctaggagaaactaggttgcatttattattatattattattaagatgaaaataggcacccaaatttaccttgacaaggacttgaacctaggtggtctgggtttacgagcacacccttgaccaagtgagctagctcagttcccttgacacaccagccagatgaaaagttgcatgtgcagctacccctttttccacgcccttttcatcttccaatctttgttggagctaccttctcatgtattcatatctttaaaaaatggttgtttgtcaggcccagctactgatatacttcatgctcaagtacgcaatggaaatactactatcagaatcgagcgttgtcaccacatactattttagctggtctacaagtgctgtggctatctttctagcgattcttggattaacggttcttccagtaaatgccattgttggaagctacgttacaaatttattcgaggataggtaagctttgtactcttacaaaacatactacatgaaacttttatattctctagacattgtttttctcttaaactgagacatgctatgcagatacatcaccagttgtttcacaaaataagaacttgctctatcatttgcaggcaaattttgttggcatctgaagtcatggttctcatcggtataatcatgagcttttgtttcacacctcactactccatcccgcaatatgttctttcagctttcatcacatttgtatttgctgaggtgcttgaaggtatgtatgtttatatacattaatggtttgagacagcgaaacctaaatcaatcatacgctgctgatttatcagccactcaacttctaacctcgagctatgcaggagtgaatctgtccttgctctcacgagtaatgtcatcgaggctttcccgagggacctacaatggtggactcctttcgacagaggccgggacgttggcccgtgtagttgcagatgccacgattactgcagccggttatctcggcacggacctccttctgaatgtcactcttctcccatcccttgtgatttgcatagtctccatcgcagcagcactctacacttacaacaatctctattgaagctattgttgctgtacaagtgtacaacaatgttcctaagctaaaatgttcctgcccacaacgggtttgtatatctgttcaagcatggtttgtaaacattttgatcaagtttgtatgcaaaatttcttgtatttagtgcatttatgtaaagattcatcctgtaaagaattataaactatgagacgctattgccatttatgatcatttatgtttatctttttagccttatgttatttgaatttgtctaatcaatgccatcttccatcacgagcacatcattgacatattactgatggatagacctttttgggacgtgagatgctaaaggcacaacctatatagctgaaaatttctaacatatttatcaataataccaagatgcctttgttgtttatcaattgcacattatttcaacgtaaatgcaattttgttaaatatgtcatggtgtcgagcctactgcttaccccagcatgttgaattgctgccttaagcagaaacatcgaaaaacctgcgtagattccacgatccaacaatcctctccgttcatttttttagttccatatgaaaggaccgattacgtctgaaagaagagtttcattagacaatctatttcttttaactaatgcctctagtttttcaaaacctatgcaataaataggtgtaactatagttttgactaagggttgtaatctctttgtaaaatatttatgcaatctcgatttcaaatctatccactagcctaacaactaataagataaaacatacaaccaagatacataatataaatacgggagcttaaatacgatatacatataaactcttattgatgactccattgtttttatcgagataccaagaaagacgcaagtttctccctagtcctcattggagcccagtccgcgcgagtaccaagctctcggtcaggtaacattgtggatagcctaggttttttgccacacacaagtgggtctttagtgtagcctcttctaaatgcttctatcaaaggtggtccaggaaaagattcaaaatggggccctagcagtagtagtattactactaacaacaataatgataaataagtaaatgctcaatgtgcataaaattgatctaagaagtacttgtaaactcatgtaatgttgtaaacttatttgcttatttctttatgtttcttttctcacatccgaacagattccttctagaggacatgattgtaagttaaaaaataaaatagaacactaattaaatcaaagctatcgctacttgctgagttacaaaattattaaatctatttataaaatactaccaattatgtcgtacttccaaattatcaaacaattgaatagattacaaaataatatttaatcaatagattacaaaatacctactacaaattcacaaaacaatttgtctagtttagtaattattcaaactatagttgtacatagtaattaatttggctttggtttagaccctcggccttggtgaacgacgaacaacgaggtatcctatgtgtagtcatgtatgatgcgtctaggatgtagatgcagtggccagtggcaatcctcagtcttcacgaatcaggatgaacatatggagggtggggcctcgcggaatagggggactagggtagtcgcccctctcgccctctccaacgtcggtactactctctatcgtcttcactatcgatttttaatcgaaataccatgcgcctagttccttccagtacacgatgatggtcacatcacagacacaatcgatgtaatctttcaagattacgaaccccttcggtataactaatacaatggtatacgcaatcatcaagtggtaagaggtgttctaacctcacttaaacactaggactaaacatagagtaagcactgtatgcagcggtctaactaacctaaacgctttataaagtatatacgctaatcgccgagcgacctttgagcattcgggtgtgtagggctactagaaataagtcttaacctgcttgcaatattttgcagcttcacacttcaaaatggtcggttgggtgtcaacttgaaaaagtcattccttttacaccccgtttagatgtagatattggagcatggaattgggaattggaactggctttcttaaattccgttgtttggttgcatatggatggttgcatatggaattgagatttggaatcaaaaaccgaatttcgtggaattggactatacctaggaatcctctctctcccaatacaagaacttc

SEQ ID NO: 8789 - protein, 748 aa, Zea mays
  misc_feature (458)..(458): Xaa can be any naturally occurring amino acid
  misc_feature (460)..(460): Xaa can be any naturally occurring amino acid
  misc_feature (549)..(549): Xaa can be any naturally occurring amino acid
LPIRGRKSIVRARRGGRRPAAAKGEISTQGYQILYLQFQTVICDVKMVNFGKKLMADQVEEWKGYYINYKLMKKMLKQYVQQTQHGGKDREQVLKEFSRILDDQIERIVLFLLQQQGHLASRIEELGEKRSALEEYDISQVYQLHDAYREVGLDLIKLLRFVDVNATGIRKILKKFDKRFGYKFTDYYVTTRANHPYSQLQQVFKQVGIVAVVGALSRNLEYLPHHEGSFVSIYDRPAVTLKDPIIDQVNHAVQKLTHATNFMQFLGQHSLIVQEDAQSGSEDLVDDQSYHFMSLMLNLVNTFLYMVNTYIIVPTADDYAVSLGAAATVCGIIIGSMAVAQVFSSVYFSAWSNKSYFKPLVFSSIVLSLGNLLYALAYDLNSLIVLLTGRLLCGLGSARAVNRRYISDCVPLKMRLQASAGFVSASALGMACGPALAGFLQIKFKIYSLSFNQRKGGXVXNTLPGWVMCISWLIYLLWLWLTFKEPEHFTKTMVNEQPSESGPQGNSNLEAGLAEPLLQGIERRQDENSEVNDDTEVESESSHEPASSXASAYRLLTPSVKAQLLIYFMLKYAMEILLSESSVVTTYYFSWSTSAVAIFLAILGLTVLPVNAFVGSYITNLFEDRQILLASEVMVLIGIIMSFCFTPHYSIPQYVLSALITFVFAEVLEGVNLSLLSRVMSSRLSRGTYNGGLLSTEAGTLARVVADATITAAGYLGTDLLLNVTLLPSLVICIVSIAATLYTYNNLY

SEQ ID NO: 8790 - DNA, 1251 bp, Zea mays
ggaaaaccgccacggccgacctcgccttctgcctctccgatccgcatctccgatccgcatctccgcttagtatatacatggggattggtagcgagcgattgattacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggccggcgccggcgccggcgctgcacgaggccgaggtcgccgccatccgcagggagatcgtcaacttccacggcgtcatggtgctgctcctcaactacagcagcatcaactacataggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctccggtccttcgacccgccgtttccgatcccgacccgatgacacttgttgctcgccgctcctagttggcttgcgccagcctcctcgatctcccttccttttcgtctagcttcttggcccgcccggtcccggcccggtacatgctgtgcactgtgcttgccttggttttccattttcccgctttctaagttctaattaactaatgtatgtagagtgcagtagtgagactacagtaaataaatgtaatttactggaatgacagccgagagaacgtacaagctcatactcaatttggttccaattttgtggaaaaaaaacctactgttaactgtgaaaaaaaa

SEQ ID NO: 8791 - protein, 252 aa, Zea mays
MVQFGKWLRRQIERSLPEWQDQFLRYKELKRCVKARSGGCPPLPAEEAEFVAEIDAETEKINAFFLDQEEEFIIRHRELQNHIERALGRGRPAPAPALHEAEVAAIRREIVNFHGVMVLLLNYSSINYIGLAKILKKYDKRTGAMLRLAVMESVLQQPFFKTETVSHLVRECESLMEAVFPEARDRGQAAAAALAVAEAEQGIFRNTVAALLTMQDVRAGSSTRGSHSLPPLNLPDSDWLRSFDPPFPIPTR

SEQ ID NO: 8792 - DNA, 1137 bp, Zea mays
aaaaacactgggtggccatcatcatcagtaactaataattactttagattagaaagcaagaatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgaccaggaggaggagttcatcatccgccaccgggagctgcagaaccacatcgagcgcgcgctgggccgcggcaggcccaggccggcgccggcgctgcacgaggccgaggtcgccgccatccgcagggagatcgtcaacttccacggcgtcatggtgctgctcctcaactacagcagcatcaactacataggctgctggctgcttgcaggcctggccaagatcctcaagaagtacgacaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctccggtccttcgacccgccgtttccgatcccgacccgatgacacatgttggcttgttgctcgctcctagttggcttgcgccagcctcctcgatctcccttccttttcgtcttcttggcccggtacatgctgtgcttgccttggttttccatttttcccgctttctaagctctaattaactaatgtatgtagagtgcagtagtgagactacagtaaataaatgtaatttactggaatgacagccgagagaacgtacaagctcatactcaatttggttccaattttgtggaaaaaaaaacctactgttaacgaaaaaaaaaaaaaaaa

SEQ ID NO: 8793 - protein, 258 aa, Zea mays
MVQFGKWLRRQIERSLPEWQDQFLRYKELKRCVKARSGGCPPLPAEEAEFVAEIDAETEKINAFFLDQEEEFIIRHRELQNHIERALGRGRPRPAPALHEAEVAAIRREIVNFHGVMVLLLNYSSINYIGCWLLAGLAKILKKYDKRTGAMLRLAVMESVLQQPFFKTETVSHLVRECESLMEAVFPEARDRGQAAAAALAVAEAEQGIFRNTVAALLTMQDVRAGSSTRGSHSLPPLNLPDSDWLRSFDPPFPIPTR

SEQ ID NO: 8794 - DNA, 1029 bp, Zea mays
ccaagttccatcccatcccgccacgaaattctccacgctccgatccaatcgcaacaatgaagttcggcaagagcctcaacaaccagatcgtggagacgctcccggactggcgcgacaagttcctgtcctacaaggacctcaagaagcggctgaagcagatcggcgccggctctggcgagcggcggagcaagcgccagcgggtgggggacgggcgcggcggatcctcgccgcctgcgatgaccccggaggaggccggattcgtcgcgctcctcgacgccgagctcgacaagttcaacgccttcttcctcgagaaggaggaggactacgtcatccggctgaaggtaattgattgaccatacccattcctgtcgtgatccgattccatccccccctcgtgttgtccgctccctcgcggcggcgcgaatagaatagtggtctgattcgtgtctcggtcgtcggaattgagcgggcgcaggagttgcaggacagggtggtgagcgccgcggaggtggggtcggcggaggagctgctgcgggtgcgcaaggagatcgtcgacttccacggcgagatggtcttgctggagaactacagcgcgctcaactacaccggtgagacgcatctcactagggatgagagagtttttatttttatttcaaaaagaaagagaggggaaaaacaatcgtgcagcgttagatttcaagattcattctaaacgtactgacagagagcaatggatgctctgcgttaaccagggctggtcaagatcctcaagaagtacgacaagaggaccggcgcgctgatccgcctgcccttcatccggaacgtgatgcaggagccgttctgcgccaccgacgtgctgtacaagctcgtcaaggggtgcgaggagatgctggaccagctcctcctgccccggaaccagcagcggcccgtgccgagcgacaacggcggggaaggagacagcgacggcgacgacgacaagcaacgaccggcggagccaggcgcctcatcgctgcccagcggcggcggcgg

SEQ ID NO: 8795 - protein, 231 aa, Zea mays
MKFGKSLNNQIVETLPDWRDKFLSYKDLKKRLKQIGAGSGERRSKRQRVGDGRGGSSPPAMTPEEAGFVALLDAELDKFNAFFLEKEEDYVIRLKELQDRVVSAAEVGSAEELLRVRKEIVDFHGEMVLLENYSALNYTGLVKILKKYDKRTGALIRLPFIRNVMQEPFCATDVLYKLVKGCEEMLDQLLLPRNQQRPVPSDNGGEGDSDGDDDKQRPAEPGASSLPSGGG

SEQ ID NO: 8796 - DNA, 1504 bp, Zea mays
cctgtggcctcgcatccccagcaccccccgttacttgtcctcctcccctggatctgtcccctattgatgcgtggcatccgccccagcaaaaactccgaagttccatcccatcccgccacgaaattctccacgctccgatccaatcgcaacaatgaagttcggcaagagcctcaacaaccagatcgtggagacgctcccggactggcgcgacaagttcctgtcctacaaggacctcaagaagcggctgaagcagatcggcgccggctctggcgagcggcggagcaagcgccagcgggtgggggacgggcgcggcggatcctcgccgcctgcgatgaccccggaggaggccggattcgtcgcgctcctcgacgccgagctcgacaagttcaacgccttcttcctcgagaaggaggaggactacgtcatccggctgaaggagttgcaggacagggtggtgagcgccgcggaggtggggtcggcggaggagctgctgcgggtgcgcaaggagatcgtcgacttccacggcgagatggtcttgctggagaactacagcgcgctcaactacaccgggctggtcaagatcctcaagaagtacgacaagaggaccggcgcgctgatccgcctgcccttcatccggaacgtgatgcaggagccgttctgcgccaccgacgtgctgtacaagctcgtcaaggggtgcgaggagatgctggaccagctcctcctgccccggaaccagcagcggcccgtgccgagcgacaacggcggggaaggagacagcgacggcgacgacgacaagcaacgaccggcggagccaggcgcctcatcgctgcccagcggcggcggcggtggcgctggcgacatggagctggaggagatcgaggacatggagagcatgtacatgaagagtacggtggccgcgctcagggcgctcagggagatcaggagcgggagctccacggtgagcgcgttctccctgccgccactacggtgattgacacgttgtgttcggttcagtagcgaagcgagacagaacggggccgactgcgctgttgctgtaggtagtgtttggttcaaagaagacacgaacaaaatgaaagaaaatctgtaaaatgatagtaatattcatctagtattctcaaaaaaaaaaaaaaaacaaaacttaaggggtgcatcgagtaggcaactaaatgacagactgaatgggcaaaacatctgatggctgaacttaaaaattttagacttggacatttgctggagatgggactgggatcccaatctcccattcagaaatttgtatgaattcaggattcctaacagctgcgaaatggtggacatgttaaatcatagaattcccagcacaaccatcggacagaattgggctgattttattcactattgtgaattgatcatgtgtttttactgatatacaaccttatgattccgtgtggcttctgattgtcataatgaaagggggaaacaggttttggctcaaaaaaaaaaaaaa

SEQ ID NO: 8797 - protein, 279 aa, Zea mays
MKFGKSLNNQIVETLPDWRDKFLSYKDLKKRLKQIGAGSGERRSKRQRVGDGRGGSSPPAMTPEEAGFVALLDAELDKFNAFFLEKEEDYVIRLKELQDRVVSAAEVGSAEELLRVRKEIVDFHGEMVLLENYSALNYTGLVKILKKYDKRTGALIRLPFIRNVMQEPFCATDVLYKLVKGCEEMLDQLLLPRNQQRPVPSDNGGEGDSDGDDDKQRPAEPGASSLPSGGGGGAGDMELEEIEDMESMYMKSTVAALRALREIRSGSSTVSAFSLPPLR

SEQ ID NO: 8798 - DNA, 1057 bp, Zea mays
cccgttgctcgtcgtcgtcctctgcatccgtcccctatttatccgtcccctcctctcccgcactagctcccaagttccatcccatcccgccacgaaattctccacgctccgatccaatcgcaacaatgaagttcggcaagagcctcaacaaccagatcgtggagacgctcccggactggcgcgacaagttcctgtcctacaaggacctcaagaagcggctgaagcagatcggcgccggctctggcgagcggcggagcaagcgccagcgggtgggggacgggcgcggcggatcctcgccgcctgcgatgaccccggaggaggccggattcgtcgcgctcctcgacgccgagctcgacaagttcaacgccttcttcctcgagaaggaggaggactacgtcatccggctgaagggctggtcaagatcctcaagaagtacgacaagaggaccggcgcgctgatccgcctgcccttcatccggaacgtgatgcaggagccgttctgcgccaccgacgtgctgtacaagctcgtcaaggggtgcgaggagatgctggaccagctcctcctgccccggaaccagcagcggcccgtgccgagcgacaacggcggggaaggagacagcgacggcgacgacgacaagcaacgaccggcggagccaggcgcctcatcgctgcccagcggcggcggcggtggcgctggcgacatggagctggaggagatcgaggacatggagagcatgtacatgaagagtacggtggccgcgctcagggcgctcagggagatcaggagcgggagctccacggtgagcgcgttctccctgccgccactacggtgattgacacgttgtgttcggttcagtagcgaagcgagacagaacggggccgactgcgctgttgctgtaggtagtgtttggttcaaagaagacacgaacaaaatgaaagaaaatctgtaaaatgatagtaatattcatctagtattctcactttataacttttctgtgtatatcttgtctgtgctgaacatcattttgtaagatcattttaagacaaaacttccattg

SEQ ID NO: 8799 - protein, 235 aa, Zea mays
  misc_feature (94)..(94): Xaa can be any naturally occurring amino acid
MKFGKSLNNQIVETLPDWRDKFLSYKDLKKRLKQIGAGSGERRSKRQRVGDGRGGSSPPAMTPEEAGFVALLDAELDKFNAFFLEKEEDYVIRXEGLVKILKKYDKRTGALIRLPFIRNVMQEPFCATDVLYKLVKGCEEMLDQLLLPRNQQRPVPSDNGGEGDSDGDDDKQRPAEPGASSLPSGGGGGAGDMELEEIEDMESMYMKSTVAALRALREIRSGSSTVSAFSLPPLR

SEQ ID NO: 8800 - DNA, 2788 bp, Zea mays
ctgcagcccactgctcctccacggcgtggatcttctccaacgcggcattcacgttcgcgcgtatgcgatggaggggaaactaggcggaagaaggcattggtggcggcattggatttctggacggcttcggaaaggagtggcgtgggaggtcaccgtgtggacgaacatgtggttgggctacgtgggggtgggcacggaggtggactagtggtggaagacagcgagctcgtcggcgagggaggttggaactgggacgcggtagccgataccctgcgcacggcccggtagcaagaaatggcaagggaaggatgcggcacacggtgaagtgatggaccgggtctgcacatttatggcccccaggaagcaagggaacgaccccggcaaactcctaggcgagagaagcggtccagccacaaccacccaaggaagaagacccggcctgagcagtaaaacaataccggaggaggaacacaagaaggtagagcaccaacacccaacttggtgatgctcgccaacaccaccatcgctctcatccaagaaaggtacgatcaagattaatcccttagattagtctaggaccctttacttcatcgaggttagattggattggccttctagagttttactaatggcattggagccaacctaagaaccctagattccctaatccaacaagttagagtcaagaatgtctctcgacccataattaagaacccacatagggatttaaagaggtagaagaagagcagtaggggagcgagtggtagccctaacccaaacacccagaattagcagaaaggggttcgagttaggtaaccctaacactaaatccccaataactcagaggaaggagatggaccgtagagggactcaagttagattaaactaaccctaattcccaagttaaggaaaagatcactcgggggaggggggttaggggtgttaaatcctaccccaatccccaaatcattagaaagggaaacaacatagaggaccttcagttaggtaaccctaacccttaatcccaaatcatcaaaaggaactgaggacaaccctaaattccaaccttccagaaccttacaaggggctcaggatggagatccaaagccccaaagcacaggtcctgaacatcgagacaaattagggttttgaaccctaaatccttccccaaatcatataaagaaatgtaccaaaggcggccggagagtgcaaattgtttttatagagacaactatcctttctacgtgccactgtaactctattaaatctatttgtacagtatgttgtaaattccaatcatctcagaaaacatatttatagagagacgtctctcatttctagtcccctctataaatctcatttctaggaacagttacaatgtgtttggtttgaggttaaagtgggatgagtcaggggcgacaccgtctcctcatttttttgggatcatgccgccatcaaaattactacggggtttatctcgcccctacgtgactctcatccaaatattattagaactatggtcgtcctattttatccctccatatatatctaaccaaacacacccggccagccacctatacaaatcatttatttacagtaaggacgactggcctacacgagacaaggccgccgtctcttagatcttaggtgctgtttggttcacatatttataacgcaatgggtaactgataacgttaaatcatgtttgttttagtccaaccgtaatcagataccacactaaaaattgataccagcctattcaaatttgttaccgccagtaatcgagcgtaaactattaccattaccatttgcgttacatttcttgaaccaaacaacaccttagttcgtagcagtggatcaaacgccggtttcatccgattgctattccccaattataataaatctccatcgtggtcaacattaaaaaaaaaactccgtcgaccctagtactgctactcgctagaattttattttgtcttctagacgagttactgatgtttgcttgctggcccatctaatccgcaggagaattgaagaagcaagcgctgttgtcctgtcacacagctagctcggtccctctatcattgttgaatggtttattcccggggaatatgccctcgctcctctggcatcatccgcagcatatatcctccgtctcgtcttccacctcggatcaggtaggcgcggcgcggaccgcaacacgccagctttcttgctcttgtctctaagcagcagcagcttcctgtctctccagccaccattccattctcgctccttggtaatgaggctggctagccagctaatgcagctccgaacctgttttgttggtggtcatttaaccatgcatgcttcgatcgatggattggtgcatgcatggattattgcatagtgtgatgcatgtggcgcatcagtgcatggttagatgaccatcagcaaacatgttcttgaggcatgcaagttctctagctacacatatcagagatcgatcaccactgcggcgccatggctacttaattgaaatggaggtttgcatttctccgaacccggatgtcgtgattctgcttccgttcttgatccaggatcttccggtcttgttcccaccattactttccttaggaaactggaatggtttcaaccttaatttgtttatgtgtgtgtgcacatgcagcgtgtgtttcatatggagatcggtgcactcaccttgtagctttagcttgcatccccttcgctaacagagagtaagatatcttagtcctctcgccatctctctctaaacatatacgtatca

SEQ ID NO: 8801 - DNA, 680 bp, Zea mays
aggtaggcgcggcgcggaccgcaatacgccagctttcttgctcttgtctctaagcagcagcagcttcctgtctctccagccaccattccattctcgctccttggtaatgaggctggctagccagctaatgcagctccgaacctgttttgttggtggtcatttaaccatgcatgcttcgatcgatggattggtgcatgcatggattattgcatagtgtgatgcatgtggcgcatcagtgcatggttagatgaccatcagcaaacatgttcttgaggcatgcaagttctctagctacacatatcagagatcgatcaccactgcggcgccatggctacttaattgaaatggaggtttgcatttctccgaacccggatgtcgtgattctgcttccgttcttgatccaggatcttccggtcttgttcccaccattactttccttaggaaactggaatggtttcaaccttaatttgtttatgtgtgtgtgcacatgcagcgtgtgtttcatatggagatcggtgcactcaccttgtagctttagcttgcatccccttcgctaacagagagtaagatatcttagtcctctcgccatctctctctaaacatatacgtatcattttgtttccgacgactctcccaatgagtccttcgattctcctgcaggatctgacgacgaaagcgat

SEQ ID NO: 8802 - DNA, 4227 bp, Artificial sequence
  synthetic construct
gtggaagacagcgagctcgtcggcgagggaggttggaactgagacgcggtagccgataccctgcgcacggcccggtagcaagaaatggcaagggaaggatgcggcacacggtgaagtgatggaccgggtctgcacatttatggcccccaggaagcaagggaacgaccccggcaaactcctaggcgagagaagcggtccagccacaaccacccaaggaagaagacccggcctgagcagtaaaacaataccggaggaggaacacaagaaggtagagcaccaacacccaacttggtgatgctcgccaacaccaccatcgctctcatccaagaaggtacgatcaagattaatcccttagattagtctaggaccctttacttcatcgaggttagattggattggccttctagagttttactaatggcattggagccaacctaagaaccctagattccctaatccaacaagttagagtcaagaatgtctctcgacccataattaagaacccacatagggatttaaagaggtagaagaagagcagtaggggagcgagtggtagccctaacccaaacacccagaattagcagaaaggggttcgagttaggtaaccctaacactaaatccccaataactcagaggaaggagatggaccgtagagggactcaagttagattaaactaaccctaattcccaagttaaggaaaagatcactcgggggaggggggttaggggtgttaaatcctaccccaatccccaaatcattagaaagggaaacaacatagaggaccttcagttaggtaaccctaacccttaatcccaaatcatcaaaaggaactgaggacaaccctaaattccaaccttccagaaccttacaaggggctcaggatggagatccaaagccccaaagcacaggtcctgaacatcgagacaaattagggttttgaaccctaaatccttccccaaatcatataaagaaatgtaccaaaggcggccggagagtgcaaattgtttttgtagagacaactatcctttctacgtgccactgtaactctattaaatctatttgtacagtatgttgtaaattccaatcatctcagaaaacatatttatagagagacgtctctcatttctagtcccctctataaatctcatttctaggaacagttacaatgtgtttggtttgaggttaaagtgggatgagtcaggggcgacaccgtctcctcatttttttgggatcatgccgccatcaaaattactacggggtttatctcgcccctacgtgactctcatccaaatattattagaactatggtcgtcctattttatccctccatatatatctaaccaaacacacccggccagccacctatacaaatcatttatttacagtaaggacgactggcctacacgagacaaggccgccgtctcttagatcttaggtgctgtttggttcacatatttataacgcaatgggtaactgataacgttaaatcatgtttgttttagtccaaccgtaatcagataccacactaaaaattgataccagcctattcaaatttgttaccgccagtaatcgagcgtaaactattaccattaccatttgcgttacatttcttgaaccaaacaacaccttagttcgtagcagtggatcaaacgccggtttcatccgattgctattccccaattataataaatctccatcgtggtcaacattaaaaaaaaaactccgtcgaccctagtactgctactcgctagaattttattttgtcttctagacgagttactgatgtttgcttgctggcccatctaatccgcaggagaattgaagaagcaagcgctgttgtcctgtcacacagctagctcggtccctctatcattgttgaatggtttattcccggggaatatgccctcgctcctctggcatcatccgcagcatatatcctccgtctcgtcttccacctcggatcaggtaggcgcggcgcggaccgcaacacgccagctttcttgctcttgtctctaagcagcagcagcttcctgtctctccagccaccattccattctcgctccttggtaatgaggctggctagccagctaatgcagactagaggatctccatggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 8803 - DNA, 5032 bp, Artificial sequence
  synthetic construct
gtggaagacagcgagctcgtcggcgagggaggttggaactgagacgcggtagccgataccctgcgcacggcccggtagcaagaaatggcaagggaaggatgcggcacacggtgaagtgatggaccgggtctgcacatttatggcccccaggaagcaagggaacgaccccggcaaactcctaggcgagagaagcggtccagccacaaccacccaaggaagaagacccggcctgagcagtaaaacaataccggaggaggaacacaagaaggtagagcaccaacacccaacttggtgatgctcgccaacaccaccatcgctctcatccaagaaggtacgatcaagattaatcccttagattagtctaggaccctttacttcatcgaggttagattggattggccttctagagttttactaatggcattggagccaacctaagaaccctagattccctaatccaacaagttagagtcaagaatgtctctcgacccataattaagaacccacatagggatttaaagaggtagaagaagagcagtaggggagcgagtggtagccctaacccaaacacccagaattagcagaaaggggttcgagttaggtaaccctaacactaaatccccaataactcagaggaaggagatggaccgtagagggactcaagttagattaaactaaccctaattcccaagttaaggaaaagatcactcgggggaggggggttaggggtgttaaatcctaccccaatccccaaatcattagaaagggaaacaacatagaggaccttcagttaggtaaccctaacccttaatcccaaatcatcaaaaggaactgaggacaaccctaaattccaaccttccagaaccttacaaggggctcaggatggagatccaaagccccaaagcacaggtcctgaacatcgagacaaattagggttttgaaccctaaatccttccccaaatcatataaagaaatgtaccaaaggcggccggagagtgcaaattgtttttgtagagacaactatcctttctacgtgccactgtaactctattaaatctatttgtacagtatgttgtaaattccaatcatctcagaaaacatatttatagagagacgtctctcatttctagtcccctctataaatctcatttctaggaacagttacaatgtgtttggtttgaggttaaagtgggatgagtcaggggcgacaccgtctcctcatttttttgggatcatgccgccatcaaaattactacggggtttatctcgcccctacgtgactctcatccaaatattattagaactatggtcgtcctattttatccctccatatatatctaaccaaacacacccggccagccacctatacaaatcatttatttacagtaaggacgactggcctacacgagacaaggccgccgtctcttagatcttaggtgctgtttggttcacatatttataacgcaatgggtaactgataacgttaaatcatgtttgttttagtccaaccgtaatcagataccacactaaaaattgataccagcctattcaaatttgttaccgccagtaatcgagcgtaaactattaccattaccatttgcgttacatttcttgaaccaaacaacaccttagttcgtagcagtggatcaaacgccggtttcatccgattgctattccccaattataataaatctccatcgtggtcaacattaaaaaaaaaactccgtcgaccctagtactgctactcgctagaattttattttgtcttctagacgagttactgatgtttgcttgctggcccatctaatccgcaggagaattgaagaagcaagcgctgttgtcctgtcacacagctagctcggtccctctatcattgttgaatggtttattcccggggaatatgccctcgctcctctggcatcatccgcagcatatatcctccgtctcgtcttccacctcggatcaggtaggcgcggcgcggaccgcaacacgccagctttcttgctcttgtctctaagcagcagcagcttcctgtctctccagccaccattccattctcgctccttggtaatgaggctggctagccagctaatgcagactaggaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcggactaggaccatggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcgggaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 8804 - DNA, 1961 bp, Zea mays
gtggaagacagcgagctcgtcggcgagggaggttggaactgagacgcggtagccgataccctgcgcacggcccggtagcaagaaatggcaagggaaggatgcggcacacggtgaagtgatggaccgggtctgcacatttatggcccccaggaagcaagggaacgaccccggcaaactcctaggcgagagaagcggtccagccacaaccacccaaggaagaagacccggcctgagcagtaaaacaataccggaggaggaacacaagaaggtagagcaccaacacccaacttggtgatgctcgccaacaccaccatcgctctcatccaagaaggtacgatcaagattaatcccttagattagtctaggaccctttacttcatcgaggttagattggattggccttctagagttttactaatggcattggagccaacctaagaaccctagattccctaatccaacaagttagagtcaagaatgtctctcgacccataattaagaacccacatagggatttaaagaggtagaagaagagcagtaggggagcgagtggtagccctaacccaaacacccagaattagcagaaaggggttcgagttaggtaaccctaacactaaatccccaataactcagaggaaggagatggaccgtagagggactcaagttagattaaactaaccctaattcccaagttaaggaaaagatcactcgggggaggggggttaggggtgttaaatcctaccccaatccccaaatcattagaaagggaaacaacatagaggaccttcagttaggtaaccctaacccttaatcccaaatcatcaaaaggaactgaggacaaccctaaattccaaccttccagaaccttacaaggggctcaggatggagatccaaagccccaaagcacaggtcctgaacatcgagacaaattagggttttgaaccctaaatccttccccaaatcatataaagaaatgtaccaaaggcggccggagagtgcaaattgtttttgtagagacaactatcctttctacgtgccactgtaactctattaaatctatttgtacagtatgttgtaaattccaatcatctcagaaaacatatttatagagagacgtctctcatttctagtcccctctataaatctcatttctaggaacagttacaatgtgtttggtttgaggttaaagtgggatgagtcaggggcgacaccgtctcctcatttttttgggatcatgccgccatcaaaattactacggggtttatctcgcccctacgtgactctcatccaaatattattagaactatggtcgtcctattttatccctccatatatatctaaccaaacacacccggccagccacctatacaaatcatttatttacagtaaggacgactggcctacacgagacaaggccgccgtctcttagatcttaggtgctgtttggttcacatatttataacgcaatgggtaactgataacgttaaatcatgtttgttttagtccaaccgtaatcagataccacactaaaaattgataccagcctattcaaatttgttaccgccagtaatcgagcgtaaactattaccattaccatttgcgttacatttcttgaaccaaacaacaccttagttcgtagcagtggatcaaacgccggtttcatccgattgctattccccaattataataaatctccatcgtggtcaacattaaaaaaaaaactccgtcgaccctagtactgctactcgctagaattttattttgtcttctagacgagttactgatgtttgcttgctggcccatctaatccgcaggagaattgaagaagcaagcgctgttgtcctgtcacacagctagctcggtccctctatcattgttgaatggtttattcccggggaatatgccctcgctcctctggcatcatccgcagcatatatcctccgtctcgtcttccacctcgg

SEQ ID NO: 8805 - DNA, 136 bp, Zea mays
atcaggtaggcgcggcgcggaccgcaacacgccagctttcttgctcttgtctctaagcagcagcagcttcctgtctctccagccaccattccattctcgctccttggtaatgaggctggctagccagctaatgcag

SEQ ID NO: 8806 - DNA, 1839 bp, Artificial sequence
  synthetic construct
atggtccgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcg

SEQ ID NO: 8807 - DNA, 277 bp, Artificial sequence
  synthetic construct
tcggctacagcctcgggaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 8808 - DNA, 819 bp, Artificial sequence
  synthetic construct
actaggaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcggactaggacc

SEQ ID NO: 8809 - DNA, 1746 bp, Glycine max
atgtgtggtattcttgctgttcttggttgttctgatgactctcgagccaaaagggtccgcgtgcttgagctctctcgcagattgaagcaccgtggccctgactggagtgggctccatcaacatggtgactgctttttggcacatcaacggttagccatagttgatcctgcttctggggatcaacctctctttaacgaggacaaatccgtcattgttacggtaaatggagagatttacaaccatgaagagctcaggaaacagctgcctaatcacaacttccgaactggaagtgattgtgatgttattgcacacctgtacgaggaacatggagaagactttgtggacatgctggatggtatcttctcatttgttctactggacacccgtgacaacagttttatagtggctcgggatgctattggggtcacttccttgtacattggatgggggttagatggctctgtttggatttcatcagaaatgaaaggcctgaatgatgattgtgaacactttgagtgttttccacctggtcacttgtactctagcaaagaaagagggttccgcagatggtacaatcctccttggttctctgaggctattccatctgccccttatgatcctcttgttttaagacacgcctttgagcaggcagtcataaaaaggttgatgactgatgtgccttttggtgttctactctctggaggtttggactcttctttggttgcatccatcacttctcgttacttggccaacacaaaggctgctgagcagtggggatcaaagttacattcattctgtgtaggccttgagggctcaccagatttgaaggctgcaaaagaggttgctgactatctaggcactgtccaccatgagtttaccttcactgttcaggatggaatagatgccattgaagatgttatctaccatattgaaacatatgatgtgactacaattagagcaagcacacctatgtttctcatgtctcggaagattaaatcacttggtgtcaaatgggttatctcaggagaaggatctgatgagatctttggagggtatttgtacttccacaaggcacccaacaaggaggagttccacagagaaacatgccgcaagatcaaagcacttcaccaatatgattgcttgcgagccaataaatcaacatttgcttggggtctagaagcccgtgtaccatttttggacaaggcgtttatcaatgctgcaatgagtattgaccctgagtggaagatgataaaaagagatgaaggacgaattgagaagtggattctgaggagagcctttgatgatgaagagcatccttatctgccaaagcacattttatacaggcagaaagaacaattcagtgatggagttggctatagttggattgatggccttaaggcccatgctgcaaaacatgtgactgaaaaaatgatgcttaatgctggtaacatttacccccacaacaccccaaaaaccaaggaagcatattactacagaatgatctttgagaggttcttccctcagaactcagctaggctcactgttcctggaggagcaagtgttgcatgtagcacagccaaagctgttgagtgggatgctgcttggtctaacaaccttgatccctctggtagagcagcacttggagtgcacatttcagcctatgaaaaccagaacaacaagggtgtagaaattgagaagataatacctatggatgctgctccccttggtgttgccatccagggctag

SEQ ID NO: 8810 - DNA, 1680 bp, Galdieria sulphuraria
atgtgtgggattcttgcggtgttgggctcgtcgttaccggtcgaagagcttagagagttggttaaaagctgcaccaaaaaactatatcacagaggtccagatgaagaacaatatttcattagtgaagatgggtggtgtggtttaggctttgccaggttgaagattgttgatcctgagcacggtgtccagcctatgttcaacgaccaacggacagtttggagtgtcactaatggcgagctttacaaccatgaagagatccgaaaaacggaattgaacaatatgacactccattctcattctgactgcgaaataatgatacctttgtatgagaaatatgtttctagtcagcgttatgatcatgacattcaatatgtttataatcttctccgtggagtctttgcttcttgcctggttgatttgaaacgtggttttttcatggctggaagagatcctatcggggtccgagctcttttttatgggacaagtaaagatggtgctgtttggtttgcttcagaggcaaaagcaattgtggatgtttgtgattatgtgacagcattcataccaggtacctttgtgaaaggatacagaggccgcgaacaagcattttcttttacgagatattacgaaccagtgtactggcatgatcactggatgccggtttctccagttgactatcaacttttacatgacacctttgtgttgtcttgtaagcgtcgtttaatgtccgacgtgcctattggagtatttatctctggtggtttgggttcttctcttgtggcctccgtcgccaaacgcttactggatcccaactatgattttcattcttttgcttgtggtcttgaaggagcaccagatgttgctgcagcgcaaagagttgccgatttcttaggaacaaagcaccacgtattaacatttactgtggaggagggtatccaagcactagaccaagtaatatatcacttggaaacgtacgatgttaccacagttagagcatcgacgccgatgtatttgttatcaggtttgtgcaaaaagtatgtcaaagtagtgttatcaggtgaaggagcagatgaaatcttcggtggatatctctatttccacaatgcaccaaatgagattgcatttcatcaagaagttgttcgccgagtgaaacttttatacacagccgacgtattgcgtggagatagagcaacggcagcacaaagtttagaacttcgagttccgtttcttgatagagactttctggatgttgcaatgagtattcatccgcgtgaaaaggttacttctaagcatagaatcgagaaatatatcattcgctatgccttttccaaggagttttgtggtgaagagtatcttcctgacgatattctttggagacaaaaagaacagttttcggatggcgtgggctatagctggatcgatggtttaaaggcgtattgtgaaaaggccgtttccgatgcagacttgcaaaatgccgctcagcgttttccgcacgatactccaacaaccaaagaggcatatgtttaccgagctatattcgaaaaacattttgggaattgcaaggcagtacaaggtcttcgtgaatcagttgcaagatgggtacctatgtggagtgacagcacggatcctagcggtcgtgcacaaaaagttcatgtggctgcatattcaaatggaggagactag

SEQ ID NO: 8811 - DNA, 1821 bp, Zea mays
atgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgaggagcatggagaagagttcgtggacatgctggacggcgtcttctccttcgtgctgctggacactcgccatggcgaccgcgcgggcagcagcttcttcatggctgctcgcgacgccatcggtgtgacgcccctctacatcggatggggagtcgatgggtcggtgtggatttcgtcggagatgaaggccctgcacgacgagtgtgagcacttcgagatcttccctccggggcatctctactccagcaacaccggcggattcagcaggtggtacaaccctccttggtacgacgacgacgacgacgaggaggccgtcgtcaccccctccgtcccctacgacccgctggcgctaaggaaggcgttcgagaaggccgtggtgaagcggctgatgacagacgtcccgttcggcgtcctgctctccggcgggctggactcgtcgctggtggcgaccgtcgccgtgcgccacctcgcccggacagaggccgccaggcgctggggcaccaagctccactccttctgcgtgggcctggaggggtcccctgacctcaaggcggccagggaggtggcggagtacctgggcaccctgcaccatgagttccacttcactgttcaggacggcatcgacgccatcgaggacgtgatctaccacacggagacgtacgacgtcaccacgatcagggcgagcacgcccatgttcctcatgtcgcgcaagatcaagtcgctcggggtcaagatggtcatctccggcgagggctccgacgagctcttcggaggctacctctacttccacaaggcgcccaacaaggaggagttgcaccgagagacgtgtaggaaggttaaggctctgcatcagtacgactgcctgagagccaacaaggcgacatcagcttggggcctggaggctcgcgtcccgttcctggacaaggagttcatcaatgcggccatgagcatcgatcctgagtggaagatggtccagcctgatcttggaaggattgagaagtgggtgctgaggaaggcattcgacgacgaggagcagccattcctgcccaagcatatcctctacagacagaaggagcagttcagtgacggcgttgggtacagctggatcgatggcctgaaggctcatgcaacatcaaatgtgactgacaagatgctgtcaaatgcaaagttcatcttcccacacaacactccgaccaccaaggaggcctactactacaggatggtcttcgagaggttcttcccacagaaatctgctatcctgacggtacctggtgggccaagtgtggcgtgcagcacagccaaagccatcgagtgggacgcacaatggtcaggaaatctggacccctcgggaagggcggcactgggcgtccatctcgccgcctacgaacaccaacatgatcccgagcatgtcccggcggccattgcagcaggaagcggcaagaagccaaggacgattagggtggcaccgcctggcgttgccatcgagggatag

SEQ ID NO: 8812 - RNA, 21 nt, Arabidopsis thaliana
ugccaaaggagaguugcccug

SEQ ID NO: 8813 - RNA, 21 nt, Zea mays
ugccaaaggagaguugcccug

SEQ ID NO: 8814 - RNA, 21 nt, Oryza sativa
ugccaaaggagaguugcccug

SEQ ID NO: 8815 - RNA, 21 nt, Glycine max
ugccaaaggagaguugcccug

SEQ ID NO: 8816 - DNA, 647 bp, Zea mays
aaacagtgaggtcaagataagagaggaaagaactcattgtttacatgatcaggaaatggaatgcctaagctgtccagtttcagggcttctctttcttggcagggaagcatgagatgccatagctctctgctctcttcaaccctctgccaaaggagagttgccctgtaacaggactcagcttatggttcacgattgtagagacagattcaagcttacactgcagcttagtgttgtaccggcctatggtggtgcaaggtttgaatgcttcatatttttacgggctttattgcatgtttgttcaagcagccgaaagaaattagttgattttcttttcccatgccttactttgtggtttgctatttcctgaatgtgtctaggcaccggatccttttggttttctgtttttttttattaaaaaaagtttactgcaactttgctaagaagaatttgactgtacggaggaaggatggccaccaccagctcagtcctattgtcatctattttggctatcctctgggtttttgttggtataaaattggtctgctcaatcacgtacatggttcagtttttcagtaatatcatgattcagtgtcaagatttaacacggttacctaatagttgccaatcaatcatcatggtcactaatc

SEQ ID NO: 8817 - DNA, 105 bp, Zea mays
tgtccagtttcagggcttctctttcttggcagggaagcatgagatgccatagctctctgctctcttcaaccctctgccaaaggagagttgccctgtaacaggact

SEQ ID NO: 8818 - DNA, 1568 bp, Zea mays
ctaggaatggtacggtgctggctaagctagctagatcatcgtcctggagctgagagcagcagctacctatatatctagctggttttctaacgacgatgacgaacgaccgcgggactagcatgatgcagctagctgaagacagttgtaggcagctctcctctggcaggcaggcgcgcggtcatcgtcgccatcgacgacggttgcttggctctgctatgctgtgttcgttcgtccatggtgtgctagctagccgtgcatgcgttgcagtgtaacatgcgtgcatgcacgcgcgtacgtcctgccaaaggagagttgccctgcgactgtcttcagctcgaacaagatcgaccggcccggacaggaatgttgggcgtacgttgtcatcagggtttaagctccacgattccaaatattcaccacttctgggaggagttttgaagctgctcgaaagcatattgtgtctgagtgtaataaatcggcggggaatcatatgttcatgttctcactgcaagaataagcttgtcaaagagggtggtgaagtaaaatctcacctgatcagcggcacaggtgctcctagcgacgggtgtaagtcatggaggacaagcaacaggaagtccactgccaagtgcttccatcgtcgtcaaatcacaggtcaggggttaattatatgggggaagaggccattatcatcaggtacgcgtggttctcacacagtcggggccacgttcgttgatgatctgcctcttaatcggcatctcaaactcttgttgtgctctctacatcagtagagaaggtgtgttcacaagtcgtttcttcttaagactatgttttggttgatcttgagctatagaactattttattgtagaactactgaaccctttcgaagtgttgtactcaatttgtgtagaacaatgcatgattaatttctaccaatagtctacggtagccggtagttgttttatcctactagaaattgttgcatggttaattggttaatttgtgtaggatgtgccaaaagaagaggaagagaacaccatcaatatgaatggtgaattattcgtaagcttatcttccactaatggtgctggaagccagaaggagaaagaggaggatggagatcatgtgtcaaggctcaggagataaatcgaggaagaaaaagatcgaagggtggtgtttagttgtatccttccaagttccaagttcacggtaaagagaggaaagtgtgctagttcaagagagtatgggatggagataggcaccattggacttggagtggaggacaagatgttaccattttgcatttccatggagcgtggagacttctgagtgcttcaatctttttattaaaaatcagtctgagcgatgatgagtctaaagagactaagactatatcataatctacgatggatttaatctataaggtggatatatcacatatggttgccaatcttgtatatttcatatttgcatggttggtagttgcactgttgcaatcttaagacctgtatagttgcatatttgattgtgtttttagaatgttgatttgtggttgtgctcgcttctttct

SEQ ID NO: 8819 - DNA, 195 bp, Zea mays
aagacagttgtaggcagctctcctctggcaggcaggcgcgcggtcatcgtcgccatcgacgacggttgcttggctctgctatgctgtgttcgttcgtccatggtgtgctagctagccgtgcatgcgttgcagtgtaacatgcgtgcatgcacgcgcgtacgtcctgccaaaggagagttgccctgcgactgtctt

SEQ ID NO: 8820 - RNA, 23 nt, Zea mays
agguugcugaugaagucaucuaa

SEQ ID NO: 8821 - DNA, 244 bp, Zea mays
agtgagttttttttttttttttttctgtgtaacagtttggagcttatttagtccaaatggccaaaagatttaggtatctcttggagagttggtcatcacaccagaaagtcaatattagcttaagcacaatccaacactcactgtgatagatacataggttcactggttcctcgaaatttgcaggttgctgatgaagtcatctaacgctgcctttgacgatccggccgtctccagcgcggcggcg

SEQ ID NO: 8822 - RNA, 21 nt, Zea mays
ucuuugcagagugucaucuaa

SEQ ID NO: 8823 - DNA, 619 bp, Zea mays
gaccataacactcggcaaagaatcgagacctgggcaccggtataggttctttgccgagtgcagtggccctgacactcggcaaagaggcacgctttgccgagtgccctacacatcactcggcaaagaacctgacatggggacccgctggcggattctttgccgagtgctggcaggcagacactcggcaaagagtaacttctttgcagagtgtcatctaagacactcggcaaagacgccgtctctgtcaccccggcaccgtgacgatgacttttctttgccgactactgtctggcactcggcaaagtctgtgtcaagtgcccgagaaaaagtactcgacaaagaagcttttgccgatgtactgttcgtcgagccctctttgctgagtgtaacactcggcaaagcctgtgccgagtttttttcaggctttgccgagtgcttcagcgtatcaaccagccaagctcagggcgccgagttgggcacaggcgccaatgcaaggcggtacagtagccactgccttgtgcttgttccaaaggaccacgtccgtctccagagtatcctattgaacaccagcttgcgcacgagcgacaaatcactgcagcgctcgcagggagttctgtag

SEQ ID NO: 8824 - RNA, 21 nt, Zea mays
uguuugauagagaucaucuaa

SEQ ID NO: 8825 - DNA, 312 bp, Zea mays
atgttcccttcattctgcatggtttcatacaagcacaagtcatgcaccgtgaaattatgttttgtgtttgatagagatcatctaaataatcttggtctgcagcaagctttagggttcactttcactgtttgtgaaataatacaacatgacatgcttggagcgcaaccagaagatgaagagcaggtgccaccttatcccctaaatgtaaatgaattaccgtttgatttttttggcctcggtcaaccaatagggggtcaagaaggttttgatctcaatatccctcctattgaaaatatggatgatgaagcctag

SEQ ID NO: 8826 - RNA, 24 nt, Zea mays
uagggcaacuuguauccuuuggca

SEQ ID NO: 8827 - DNA, 1084 bp, Zea mays
ggcgcccacacccaaattaagcgtgcagggaaggtctcccttgttgggacatcccgcagggttttcaccatttttcccttccggggtccgaatttttgcgcagaaattgggaccgggataaacatttttcccctcgggaaacaggcaatgacccatggtttactcccacggcggctaatttaccccttactaaaagggaaaaaaccccggaagttccaaatttggtggcgccccctttaaaactaggggatcccccccccctccaggaaatcattaggcgggtgcgatggccgctccccttaccctagaaaaacccacgcccctccccctcttgataagcccacgtcggcggcagggggggcggccgccaggcttgctatagctggtccatggcaccatacatgtaagcacgcacacaggcgcacacacacgcacgcaatgatctacgtatctagcagcagcttatcatgtcgtcatcatgcatgcatggacgacggcggtcgtcatcttatctgggagcgtgtgtgtcttggcaatgggaagctgcatgcgcctctcggccggacggcgcgtagctgtagggcggcgtgccatagagctgcctcctgccgctcaccttgctgttgaggacgactgatggtggccatggccactcggcgtcggtggcggcggcgccgagttttacctctctactaaggtagggcaacttgtatcctttggcaattgttctcatctatctgggtctatctgttggctgcccggtgacggtatacggtgatgttctaatagtactcaattggtcttggagttcatgctacggctcctctgttatatattacacggctgacggctcctccttattaatgtgtactttgatgatgtcattaataatatgaatctgatgatattgaataaaaaaaaaaaaaaaaaaaaggccgctcagaaccttactttttacataacacgggcccttcttcggggggccccccaaatttcccccccctaaaagggggaggcgtttattatagcgcggcccgcccacaatgggggggggggggtttttttaaaacaaaagcgcgggggg

SEQ ID NO: 8828 - RNA, 24 nt, Zea mays
cagggcaaguugaauccuuuggca

SEQ ID NO: 8829 - DNA, 867 bp, Zea mays
tttttttttttttcattccgcagtaatgacttttattaacgatgtaatgtcatgcacaaatatctttggtccaaaggaagagcactagccaatggccaccgcgctccaccatccaagatggccaagagtagagcagagagggaaagaaagaaggaaaataaaaggtagcatgcagctaactaaaaggaggtggagtgaactgtgaagcatatacctgtgacgagcatatccatggaggccggggccggagcaggtgcaccccagctactccgatccccgtgtctatctctctgtcctgtcgtcctccccaagatctcaccagctataaatcgagtgagtgcgaacgccggcctcactcttgatcggagcgagtagctaggcagcatgacgcatgagatgaacgggtccctgaatctctgtcagcatatatacacatacacggaggtagccgccgccgaattcgtcgtgctcccatgtccatccgattggtcgtcatcaaggctgtctagagctcaagcagcagcaggaggaggttcagtgctccgcatccatatcgtcgccgtcgtcgacgacaatgcgtcggccatgtcgggcgggcagccggagggagatgctgtggcgtcgccgccggcgccacgcgtggcgttgtcttttcctgctctggttctcgattcttccctggaacaatcggaaccgaagccggcgagcgagggcggcgtctgatcgatcctccgtatgtgcagtgcagggcaagttgaatcctttggcatgtactcctatcctaacgatgaatgtacacgatcgatgatatccatttatctaactcttcaaaaaaaaaaaaaaaaagcggcccggggccgtttagag

SEQ ID NO: 8830 - RNA, 24 nt, Zea mays
uagggcaacuuguauccuuuggca

SEQ ID NO: 8831 - DNA, 426 bp, Zea mays
gggcgtcggcgcgtcggcccctaactgtagggcggcgtgccatagagttgcctcctgccgctcaccccatgctgttgacgaggactgatggtggccatgccctctcggcgtcggtggcgccggccccggccccgagttttccctctctactaaggtagggcaacttgtatcctttggcaattgttctcatctatctgggtctgtctgttggctgcccggtgccggtatacggtaatgttctaatagtactcaattggtcttggatcggagttcatgctccggctcctctgttatatattacccggctgacggctccttattaatgtgtccgttgatgatgtcattaataatatgaatctgatattgtataaaaaaaaaaaaaaaaaaaaccaaaaaaaaaaaaaaaaaaaaaaaaaaaaagcgtat

SEQ ID NO: 8832 - RNA, 24 nt, Zea mays
uagggcaccuugucuccuuuggca

SEQ ID NO: 8833 - DNA, 400 bp, Zea mays
gggagcgtgtgtgttttggcaatgggaagctgcatgccccttttgcccggacggggggtagttgtaggggggcgtcccataaagttgcctcctgccgctccccttgttgttgaggacgcctgatggtggccatgccccctcggcgtcggtggggggggccccgagttttccctttctcttaaggtagggcaccttgtctcctttggcaattgttctcctctatctgggtctatttgttggctgcccggtgccggtatccggtgatgttttaatagtcctcaattggtcttggggttcatgctagggctcctctgttatatatcccccgccccggggctcctccttattaatgtgtcctttgatgaggtccttaataatatgaatcctgatgatattgaat

SEQ ID NO: 8834 - DNA, 427 bp, Artificial sequence
  synthetic construct
  misc_feature (1)..(42): n is a, c, g, or t
  misc_feature (44)..(44): n is a, c, g, or t
  misc_feature (46)..(46): n is a, c, g, or t
  misc_feature (48)..(49): n is a, c, g, or t
  misc_feature (51)..(51): n is a, c, g, or t
  misc_feature (55)..(58): n is a, c, g, or t
  misc_feature (61)..(62): n is a, c, g, or t
  misc_feature (70)..(70): n is a, c, g, or t
  misc_feature (76)..(76): n is a, c, g, or t
  misc_feature (82)..(82): n is a, c, g, or t
  misc_feature (85)..(85): n is a, c, g, or t
  misc_feature (101)..(101): n is a, c, g, or t
  misc_feature (104)..(106): n is a, c, g, or t
  misc_feature (109)..(109): n is a, c, g, or t
  misc_feature (116)..(116): n is a, c, g, or t
  misc_feature (119)..(119): n is a, c, g, or t
  misc_feature (137)..(137): n is a, c, g, or t
  misc_feature (140)..(140): n is a, c, g, or t
  misc_feature (155)..(155): n is a, c, g, or t
  misc_feature (157)..(164): n is a, c, g, or t
  misc_feature (168)..(168): n is a, c, g, or t
  misc_feature (178)..(178): n is a, c, g, or t
  misc_feature (182)..(182): n is a, c, g, or t
  misc_feature (186)..(187): n is a, c, g, or t
  misc_feature (240)..(240): n is a, c, g, or t
  misc_feature (242)..(242): n is a, c, g, or t
  misc_feature (259)..(259): n is a, c, g, or t
  misc_feature (266)..(266): n is a, c, g, or t
  misc_feature (271)..(271): n is a, c, g, or t
  misc_feature (277)..(277): n is a, c, g, or t
  misc_feature (285)..(285): n is a, c, g, or t
  misc_feature (299)..(303): n is a, c, g, or t
  misc_feature (306)..(306): n is a, c, g, or t
  misc_feature (316)..(317): n is a, c, g, or t
  misc_feature (336)..(337): n is a, c, g, or t
  misc_feature (339)..(339): n is a, c, g, or t
  misc_feature (342)..(342): n is a, c, g, or t
  misc_feature (344)..(347): n is a, c, g, or t
  misc_feature (350)..(352): n is a, c, g, or t
  misc_feature (369)..(369): n is a, c, g, or t
  misc_feature (371)..(371): n is a, c, g, or t
  misc_feature (379)..(379): n is a, c, g, or t
  misc_feature (383)..(383): n is a, c, g, or t
  misc_feature (399)..(402): n is a, c, g, or t
  misc_feature (411)..(411): n is a, c, g, or t
  misc_feature (414)..(427): n is a, c, g, or t
nnnnnnnnnnnnnnnnnnnnnnnnnnnnnnnnnnnnnnnnnntngncnngncggnnnntanntgtagggnggcgtnccatanagntgcctcctgccgctcnccnnntgntgttgangangactgatggtggccatgnccnctcggcgtcggtggngnnnnnnnnggcnccgagttttncctntctnntaaggtagggcaacttgtatcctttggcaattgttctcatctatctgggtctntntgttggctgcccggtgncggtatncggtnatgttntaatagtnctcaattggtcttnnnnnggngttcatgctnnggctcctctgttatatatnncncgncnnnnggnnnctccttattaatgtgtncnttgatgangtcnttaataatatgaatcnnnntgatattgnatnnnnnnnnnnnnnn

SEQ ID NO: 8835 - RNA, 24 nt, Glycine max
uagggcaacuucgauccuuuggca

SEQ ID NO: 8836 - DNA, 484 bp, Glycine max
  misc_feature (51)..(51): n is a, c, g, or t
  misc_feature (55)..(55): n is a, c, g, or t
  misc_feature (452)..(452): n is a, c, g, or t
aaaaaatccactaaaaccctaacatccattgttgaaattctctttggcccnaccnccatatatggccatcccctaaagaaagtgaagatgaagaaccctctgattgatacgaagatctcaccataaagggctttggaggttcagattctctttaggggatggcctaaacacacaagagtactcacaaaaggtaagaagaaggaagatatctctcttggagattatgattatgaaaatatgaattgtgtttatgtaggtgttgtgtgaatgataatcatcatcatctttatcattatggtgatgatgaggattgtgtgtgaatggagcaatgaagattgcatgaaggttgatgaagacaagcttgatttgtcttttgttatctccctcgttagggcaacttcgatcctttggcaagcttcggttcccctcggaatcagcagattattactacnttacttaccctctttgatctctttgtctatgt

SEQ ID NO: 8837 - RNA, 24 nt, Glycine max
uagggcaacuucuauccuuuggca

SEQ ID NO: 8838 - DNA, 476 bp, Glycine max
  misc_feature (348)..(348): n is a, c, g, or t
ctctcacgcccggtcctgcccacgtacggccggcagggcggggcagggcacactccgttatccaatccggcgtccgtgcacgcagcgcacaccatgtaggccacaagatctcagatagcttatgtcacggtggtggcataagctaccagtaccagctgcatgcctgtgctcttcttcacttggaggcttggagtgtgccctcggccatggcccatgggcgcgtaagtagcacccgatggatccggcgttggctagccatctccatcctccatcaagctgcagctagctaggctacttgggttcttgaggaagatctgggtgaaacggccatggccggccggcagggcntcgtccacggcggcggcggcggcaacttttcacctctactaaggtagggcaacttctatcctttggcaattgtcacttcttgatcgggggcgtgatgatctctctcctgtgagtaccggtgacagatc

SEQ ID NO: 8839 - RNA, 24 nt, Glycine max
aagggcaacuucaauccuuuggca

SEQ ID NO: 8840 - DNA, 528 bp, Glycine max
ggtgtggctataatggtatcctccttatctttccatgctccttttctttcaaggctatgctaaaacgctccttcttgagggcggtttctcttggaaagggcaacttcaatcctttggcatttttcaactcctccacctcacttcacacactgtgatttgggctcttgagggacctctcagaatggcaacaccccttttatgtgtaccgtactctcttctagttcttttcttgtacaacaaaatttagatgcagtttcttagatgttggtgttgctttctaatcaaaattggagttttaccttggtggcacccagattatcgaggtaaaactctgattttgatagaaaaatgacaccaaaaacactataagaactgtatgtaagttttgtcgtgttttgtaatccttgtttgtgatgtgatgatttcagctgcaaactatctctacgagtctgatcatggttactatagactacatatgttatctaataaatgtacgtttgaataggcctttggccatagtgtattgtt

SEQ ID NO: 8841 - RNA, 24 nt, Glycine max
aagggcaacuuccauccuuuggca

SEQ ID NO: 8842 - DNA, 417 bp, Glycine max
gcccttctcgaataaccctcgctgccctctgtggtagtggaggtggtggagattcatagatggtgcgtttttgtcaatgtttccttttggttcaatcatggtcgagaaagaatatgtaataagttaaaagattgctgggaatgacgaaccgtccttcttaagggcgaattccctcgaaaagggcaacttccatcctttggcattttccaattaattcctcaaactcacttcactttgtgtgtgaatcaagttctcgaaggaactttggcaatatagtatataatatccctatactatgtactatatactgtactctttggtatcttgtactttgtgcttcaattagaactggattttatatgtatcagtgtatcactttcaacatatatgatatgatactgcctactatatatagta

SEQ ID NO: 8843 - RNA, 24 nt, Glycine max
aagggcaacuuccauccuuuggca

SEQ ID NO: 8844 - DNA, 757 bp, Glycine max
tctcgattctataacacccaatccaacattcattctcgaaccctctccaaactgcaccccttctcgaataatagccctcgctgcctctgtggcagtggaggtggtggagatgcatatggtgcatttttgtcggtgtttccttttggttcaatcatggtggagcatgaatattatgtaataagttgaaagattgctgggaatgaaccgttctttttcttaagggcgaattctcttcaaaagggcaacttccatcctttggcattttccaattcctcgaactcacttcactttgtgtgtgaatcaagttctcaggggaactttggcaatatatatgtaatatccctatactatgtactattaattgtactctttgttatcttgtactttgtgtttaaattagaattgcattatatatatatatatatatatatatatatatatatatatatatgtacactatcaagtatcaatatgtatgatatgatgctgcctaatatatagtataataggcagccaataaatgttggtttttagaggacgggtggcgcgggggagggggaggcgggcgggggggacggggggggggagggggggatggtagtagggggagagggcgcgcgttgtaaaaaggcagggtggtggcggcgggctgcagagaggtgggggtgtgttgggccggaaggagaagggatgcgcgccgggttggaaggcggaggtgagggagctcgcgtggccaagtgtgtcggcttggacgaga

SEQ ID NO: 8845 - RNA, 20 nt, Artificial sequence
  synthetic construct
uuggacugaaaggagcuccu

SEQ ID NO: 8846 - RNA, 23 nt, Glycine max
gggaguuucuaccuccaguccaa

SEQ ID NO: 8847 - DNA, 1769 bp, Glycine max
agaattttctaaacatcgtactgtgtttgaggcggagaatagctccaacagttcccaaattggaaccctagcattcgccattgccgccacctttccccacgcagcttttgttgtagcaaaagattgatattttcttcttcgtctataaaacccacacgtcaagtcacttctttttaaactcaattttcggtcccctcccctagctctatattttctcattcgcagagaagaaaaatcgaagcgtgtggattagaaaggggttcattttgctgattctctagctatggccgctaagattcttgcaaacttgattgtaatgggtggaggaatcttggcaagagcagttgttcaggcatatcgtcaagcgcttactaatgcctcaaaaaatggtgttgcacaagagacaattcaaaatactatgcgcagagctagcaaggtgatgacagagcaagaggctaggcagattcttggtgttaccgaggaaactccctgggaggagattatcaagaaatatgacaatttatttgagaataatgctaagaatgggagtttctacctccagtccaaagttcatcgggccaaggaatgtctagaggcagttcaacaaggcaagagtcagggtacccctagttgagaacttgcattttcaccattttataacccttgtgtaatcatttttgcctccaagttgttgtatactatttgcataatcagaagtttctgaactaaattttattattatcaaaattgtaaatgattagtttgggattgactgccaataaaggctactataaaatgaaattacatgcatgtttttaacatgcttaaaattagaatgtggtaggaaataatagtaatgtcgtaaaaaaacacacgtttcattacttgatcaaaaaaaaaaaaaaaaaaaaactcgagactagttctcctcgtgccgaattcggcacgagggagagagagaactagtctcgagtttttttttttttggaaatgcatataagagatcatgttgattcgcaaacgcagtaacagcattgttttcagctaataacataagacgaattaaaccaaacaaaaatgtatcaaaacatcaaaaaggagaaaccagtgcctctaacaactgggtgcccaatttgacaacataattataaaagcaacggaaatcaactacttggattaacgcactacttggatctctgtctcatctttcggcgcttcctcttcaacctcctcatacgcttcttcttccacttggctctcatcgcgaactgaacaccgaaccctttttcgtttctgaaccctagcctaagctgctgagaggtaacagagatccaagtagtgcggaaatcaactacttggattaacgcactacttggatctctgtctcatctttcggcgcttcctcttcaacctcctcatacgcttcttcttccacttggctctcatcgcgaactgaacaccgaaccctttttcgtttctgaaccctagcctaagctgcgagagagagaactagtctcgagttttttttttttttttttgataataaaatttttacttcagaaacttttgattacgcaaatagtacaacacaaacttggaggcaaaaatgattacacaatggttataaaatggagaaaatctaagttctcaactaggggtaccctgactcttgccttgttgaactgcctctagacattccttggcccgatgaactttggactggaggtagaaactcccattcttagcattattctcaaataaattgtcat

SEQ ID NO: 8848 - RNA, 20 nt, Zea mays
gggagcgccaaucaguccaa

SEQ ID NO: 8849 - DNA, 804 bp, Zea mays
agtgcatgcaaagttcaaagcaaacagggagttcgaaagacgtttcgctgttgcacgacacgaaccgaacgaaagttgcgtcgttgtgattccacagattcccacacgcaccagaaaagctagcatgcatctcgtttagtccaagtccacaacagtgcacaccaatgtcttccacagatcacggaaagacggcagaaacctgcagagacgatgcatggatgtatggatcccatcccatcctgtcctgtaagatctacacacacaagcaaagcaaatagacttattgcccttggttattaataaaaatgcttcctttataaaaaaacaaaaacaagcaaagcaaatgaaggtcgatctccttttcttttcttcagaacgaaactatatatgggatctcttttttggaagagaacaatatgtagattcaacgagcagatcaaggatttagagctagtttataaatcaaaagcgcaaggaaagtacaaaaaaagctttggatctccattatatatacacagaacgtaactgctatataacaattaaccagcagagaagaacagtaagcacgcacatgataagagactaaaataggcccgtcgttttggcagctgctatgtatgcatcagatgccaaccaaacatgtaagttaagcagctcaagcaaagacagaccccatgaagctagtaaaaccatgagatatgacgaagctgatgcatggatcgataaaggtaaacaaggagcgagggaggagggagcgccaatcagtccaagcaaagacggtgtgaggaaaagcttcccggccgg

SEQ ID NO: 8850 - RNA, 21 nt, Glycine max
uguguucucaggucaccccuu

SEQ ID NO: 8851 - RNA, 21 nt, Artificial sequence
  synthetic construct
aaggggugacaugagaacaca

SEQ ID NO: 8852 - RNA, 21 nt, Artificial sequence
  synthetic construct
aaggggugacacuagaacaca

What is claimed is:

1. A recombinant DNA construct comprising a heterologous promoter functional in a plant cell and operably linked to DNA encoding an RNA transcript consisting essentially of at least one miRNA decoy sequence that is recognized and bound by an endogenous mature plant miRNA but not cleaved, wherein
said miRNA decoy sequence is an RNA sequence of between about 19 to about 36 contiguous RNA nucleotides, wherein said miRNA decoy sequence is recognized and bound by said endogenous mature plant miRNA, resulting in base-pairing between said miRNA decoy sequence and said endogenous mature plant miRNA, thereby forming a cleavage-resistant RNA duplex comprising at least one mismatch between said miRNA decoy sequence and said endogenous mature plant miRNA at positions 9, 10, or 11 of said endogenous mature plant miRNA, or at least one insertion at a position in said miRNA decoy sequence corresponding to positions 10-11 of said endogenous mature plant miRNA.

2. The recombinant DNA construct of claim 1, wherein said at least one miRNA decoy sequence comprises (a) a naturally occurring miRNA decoy sequence, or (b) a synthetic miRNA decoy sequence, or (c) both a naturally occurring miRNA decoy sequence and a synthetic miRNA decoy sequence.

3. A non-natural transgenic plant cell comprising the recombinant DNA construct of claim 1.

4. A non-natural transgenic plant regenerated from the non-natural transgenic plant cell of claim 3, or a progeny plant of a regenerated plant prepared from the non-natural transgenic plant cell of claim 3, wherein said non-natural transgenic plant comprises said recombinant DNA construct and has at least one altered trait, relative to a plant lacking said recombinant DNA construct, selected from the group of traits consisting of:
(a) improved abiotic stress tolerance;
(b) improved biotic stress tolerance;
(c) improved resistance to a pest or pathogen of said plant;
(d) modified primary metabolite composition;
(e) modified secondary metabolite composition;
(f) modified trace element, carotenoid, or vitamin composition;
(g) improved yield;
(h) improved ability to use nitrogen or other nutrients;
(i) modified agronomic characteristics;
(j) modified growth or reproductive characteristics; and
(k) improved harvest, storage, or processing quality.

5. A method of providing a non-natural transgenic crop plant having at least one altered trait, comprising expressing said recombinant DNA construct of claim 1 in said non-natural transgenic crop plant, thereby resulting in said non-natural transgenic crop plant exhibiting at least one altered trait, relative to a crop plant in which said recombinant DNA construct is not expressed, selected from the group of traits consisting of:
(i) improved abiotic stress tolerance;
(ii) improved biotic stress tolerance;
(iii) improved resistance to a pest or pathogen of said plant;
(iv) modified primary metabolite composition;
(v) modified secondary metabolite composition;
(vi) modified trace element, carotenoid, or vitamin composition;
(vii) improved yield;
(viii) improved ability to use nitrogen or other nutrients;
(ix) modified agronomic characteristics;
(x) modified growth or reproductive characteristics; and
(xi) improved harvest, storage, or processing quality.

6. A recombinant DNA construct of claim 1, wherein said cleavage-resistant RNA duplex further comprises
(a) 1 or 2 mismatches between said miRNA decoy sequence and said endogenous mature plant miRNA at positions 1, 2, 3, 4, 5, 6, 7, 8, and 9 of said endogenous mature plant miRNA,
(b) 1, 2, or 3 mismatches between said miRNA decoy sequence and said endogenous mature plant miRNA at positions 12 through the last position of said endogenous mature plant miRNA, wherein each of said mismatches at positions 12 through the last position of said endogenous mature plant miRNA is adjacent to at least one complementary base-pair, or
(c) a combination of (a) and (b).

* * * * *